United States Patent
Roos et al.

(10) Patent No.: US 11,608,513 B2
(45) Date of Patent: Mar. 21, 2023

(54) METHOD FOR ADDING CAP STRUCTURES TO RNA USING IMMOBILIZED ENZYMES

(71) Applicant: CureVac SE, Tübingen (DE)

(72) Inventors: Tilmann Roos, Kusterdingen (DE); Benyamin Yazdan Panah, Tübingen (DE); Markus Conzelmann, Tübingen (DE); Andreas Thess, Kusterdingen (DE); Dominik Buob, Tübingen (DE); Martin Kunze, Rottenburg (DE); Veronika Wagner, Ellwangen (DE)

(73) Assignee: CureVac SE, Tübingen (DE)

( * ) Notice: Subject to any disclaimer, the term of this patent is extended or adjusted under 35 U.S.C. 154(b) by 0 days.

(21) Appl. No.: 15/580,121

(22) PCT Filed: May 30, 2016

(86) PCT No.: PCT/EP2016/062192
§ 371 (c)(1),
(2) Date: Dec. 6, 2017

(87) PCT Pub. No.: WO2016/193226
PCT Pub. Date: Dec. 8, 2016

(65) Prior Publication Data
US 2018/0237817 A1    Aug. 23, 2018

(30) Foreign Application Priority Data
May 29, 2015  (WO) ................. PCT/EP2015/062044

(51) Int. Cl.
| | | |
|---|---|---|
| *C12N 11/02* | (2006.01) | |
| *C12N 9/12* | (2006.01) | |
| *C12P 19/34* | (2006.01) | |
| *C12N 9/10* | (2006.01) | |
| *C12N 9/16* | (2006.01) | |
| *C12N 11/087* | (2020.01) | |
| *C12N 11/098* | (2020.01) | |

(52) U.S. Cl.
CPC ............ *C12P 19/34* (2013.01); *C12N 9/1007* (2013.01); *C12N 9/1241* (2013.01); *C12N 9/16* (2013.01); *C12N 11/02* (2013.01); *C12N 11/087* (2020.01); *C12N 11/098* (2020.01); *C12Y 201/01056* (2013.01); *C12Y 201/01057* (2013.01); *C12Y 207/0705* (2013.01); *C12Y 301/03033* (2013.01)

(58) Field of Classification Search
None
See application file for complete search history.

(56) References Cited

U.S. PATENT DOCUMENTS

| | | | |
|---|---|---|---|
| 6,312,926 B1 | 11/2001 | Shatkin et al. | |
| 7,166,451 B1 * | 1/2007 | Yang ...................... | C12N 11/06 435/180 |
| 7,348,008 B2 * | 3/2008 | Braun .................. | C07K 14/415 424/184.1 |
| 2005/0032730 A1 | 2/2005 | Von der Mulbe et al. | |
| 2005/0048472 A1 | 3/2005 | Romette et al. | |
| 2005/0059624 A1 | 3/2005 | Hoerr et al. | |
| 2005/0250723 A1 | 11/2005 | Hoerr et al. | |
| 2006/0188490 A1 | 8/2006 | Hoerr et al. | |
| 2007/0172430 A1 | 7/2007 | Brito et al. | |
| 2008/0025944 A1 | 1/2008 | Hoerr et al. | |
| 2008/0267873 A1 | 10/2008 | Hoerr et al. | |
| 2009/0324584 A1 | 12/2009 | Hoerr et al. | |
| 2010/0048883 A1 | 2/2010 | Ketterer et al. | |
| 2010/0189729 A1 | 7/2010 | Hoerr et al. | |
| 2010/0203076 A1 | 8/2010 | Fotin-Mleczek et al. | |
| 2010/0291156 A1 | 11/2010 | Barner et al. | |
| 2010/0305196 A1 | 12/2010 | Probst et al. | |
| 2011/0053829 A1 | 3/2011 | Baumhof et al. | |
| 2011/0250225 A1 | 10/2011 | Fotin-Mleczek et al. | |
| 2012/0021043 A1 | 1/2012 | Kramps et al. | |
| 2012/0258046 A1 | 10/2012 | Mutzke | |

(Continued)

FOREIGN PATENT DOCUMENTS

| | | |
|---|---|---|
| WO | WO 2000/036082 | 6/2000 |
| WO | WO 2001/090298 | 11/2001 |

(Continued)

OTHER PUBLICATIONS

Schnierle et al. (Proc. Natl. Acad. Sci. USA, vol. 89, pp. 2897-2901, Apr. 1992).*
Homaei et al., "Enzyme immobilization: an update," *J. Chem. Biol.*, 6(4):185-205, 2013.
International Preliminary Report on Patentability issued in corresponding PCT Application No. PCT/EP2016/062192, dated Dec. 5, 2017.
International Search Report and Written Opinion issued in corresponding PCT Application No. PCT/EP2016/062192, dated Jul. 4, 2016.

(Continued)

*Primary Examiner* — Richard G Hutson
(74) *Attorney, Agent, or Firm* — Parker Highlander PLLC

(57) ABSTRACT

The present invention relates to an immobilized capping enzyme, preferably an immobilized Vaccinia virus capping enzyme. Furthermore, the present invention relates to an immobilized cap-specific nucleoside 2'-O-methyltransferase, preferably an immobilized Vaccinia virus cap-specific nucleoside 2'-O-methyltransferase. Moreover, the present invention relates to a method for immobilizing said enzymes and to a method of using said enzymes for the addition of a 5'-cap structure to RNAs. Moreover, the present invention relates to an enzyme reactor for performing the capping reaction using said immobilized enzymes and the subsequent separation of the 5'-capped RNA product. In addition, the present invention relates to a kit comprising the capping enzyme and/or the cap-specific nucleoside 2'-O-methyltransferase.

15 Claims, 17 Drawing Sheets

Specification includes a Sequence Listing.

(56) References Cited

U.S. PATENT DOCUMENTS

| | | | |
|---|---|---|---|
| 2013/0042334 A1* | 2/2013 | Jais | C12N 9/1007 800/14 |
| 2013/0129754 A1 | 5/2013 | Thess et al. | |
| 2013/0142818 A1 | 6/2013 | Baumhof et al. | |
| 2013/0259879 A1 | 10/2013 | Baumhof et al. | |
| 2013/0280283 A1 | 10/2013 | Lorenz et al. | |
| 2013/0295043 A1 | 11/2013 | Kallen et al. | |
| 2013/0336998 A1 | 12/2013 | Kallen et al. | |
| 2015/0037326 A1 | 2/2015 | Butler-Ransohoff et al. | |
| 2015/0050302 A1 | 2/2015 | Thess | |
| 2015/0057340 A1 | 2/2015 | Thess et al. | |
| 2015/0093413 A1 | 4/2015 | Thess et al. | |
| 2015/0118183 A1 | 4/2015 | Baumhof | |
| 2015/0118264 A1 | 4/2015 | Baumhof et al. | |
| 2015/0165006 A1 | 6/2015 | Thess et al. | |
| 2015/0184195 A1 | 7/2015 | Thess et al. | |
| 2015/0218554 A1 | 8/2015 | Thess | |
| 2015/0306249 A1 | 10/2015 | Baumhof et al. | |
| 2015/0320847 A1 | 11/2015 | Thess et al. | |
| 2016/0130345 A1 | 5/2016 | Fotin-Mleczek et al. | |
| 2016/0166668 A1 | 6/2016 | Kallen et al. | |
| 2016/0166678 A1 | 6/2016 | Kallen et al. | |
| 2016/0166710 A1 | 6/2016 | Baumhof | |
| 2016/0166711 A1 | 6/2016 | Schnee et al. | |
| 2016/0168207 A1 | 6/2016 | Kramps et al. | |
| 2016/0168227 A1 | 6/2016 | Kallen et al. | |
| 2016/0235864 A1 | 8/2016 | Schlake et al. | |
| 2016/0304883 A1 | 10/2016 | Grund et al. | |
| 2016/0304938 A1 | 10/2016 | Wochner | |
| 2016/0326575 A1 | 11/2016 | Von Der Mulbe | |
| 2016/0331844 A1 | 11/2016 | Fotin-Mleczek et al. | |
| 2017/0014496 A1 | 1/2017 | Fotin-Mleczek et al. | |
| 2017/0029847 A1 | 2/2017 | Thess | |
| 2017/0114378 A1 | 4/2017 | Wocner et al. | |
| 2017/0252430 A1 | 9/2017 | Fotin-Mleczek et al. | |
| 2017/0326225 A1 | 11/2017 | Rauch et al. | |
| 2018/0044687 A1 | 2/2018 | Thess et al. | |
| 2018/0125952 A1 | 5/2018 | Fotin-Mleczek et al. | |
| 2018/0126003 A1 | 5/2018 | Hoerr | |
| 2018/0142275 A1 | 5/2018 | Roos et al. | |
| 2018/0147146 A1 | 5/2018 | Eber et al. | |
| 2018/0148727 A1 | 5/2018 | Grund et al. | |

FOREIGN PATENT DOCUMENTS

| | | |
|---|---|---|
| WO | WO 2007/120863 | 10/2007 |
| WO | WO 2016/165825 | 10/2016 |
| WO | WO 2016/165831 | 10/2016 |
| WO | WO 2016/174227 | 11/2016 |
| WO | WO 2016/184576 | 11/2016 |
| WO | WO 2016/193206 | 12/2016 |
| WO | WO 2016/203025 | 12/2016 |
| WO | WO 2017/001058 | 1/2017 |
| WO | WO 2017/009376 | 1/2017 |
| WO | WO 2017/021546 | 2/2017 |
| WO | WO 2017/025120 | 2/2017 |
| WO | WO 2017/025447 | 2/2017 |
| WO | WO 2017/036580 | 3/2017 |
| WO | WO 2017/064146 | 4/2017 |
| WO | WO 2017/081110 | 5/2017 |
| WO | WO 2017/108087 | 6/2017 |
| WO | WO 2017/109134 | 6/2017 |
| WO | WO 2017/109161 | 6/2017 |

OTHER PUBLICATIONS

Kyrieleis et al., "Crystal Structure of Vaccinia Virus mRNA Capping Enzyme Provides Insights into the Mechanism and Evolution of the Capping Apparatus," 22(3):452-465, 2014.

Shuman, "What messenger RNA capping tells US about eukaryotic evolution," *Nautre Rev. Mol. Cell Biol.*, 3(8):619-625, 2002.

UniProt Database, "mRNA-capping enzyme catalytic subunit," XP002753062, 1987.

UniProt Database, "Small subunit of mRNA capping enzyme," XP002753061, 2009.

Barbosa et al., "mRNA (nucleoside-2'-)-methyltransferase from vaccinia virus. Purification and physical properties," J. Biol. Chem., 253:7692-7697, 1978.

Chen et al., "Biochemical and Structural Insights into the Mechanisms of SARS Coronavirus RNA Ribose 2'-0-Methylation by nspl6/nspl0 Protein Complex," PLoS Pathogens, 7:el002294, 2011.

Database WPI, Derwent World Patents Index, vol. 2013, No. 51, Database accession No. 2013-L80314, 2013.

UniProt Database, "Cap-specific mRNA (nucleoside-2'-0-)-methyltransferase," Accession Q76ZT1, 2015.

UniProt Database, "Cap-specific mRNA (nucleoside-2'-0-)-methyltransferase," Accession AOA068EH19, 2015.

UniProt Database," Cap-specific mRNA (nucleoside-2'-0-)-methyltransferase," Accession Q070F5, 2015.

UniProt Database," Cap-specific mRNA (nucleoside-2'-0-)-methyltransferase," Accession Q9YW51, 2015.

* cited by examiner

Figure 5

>Chain D1, Vaccinia Virus Capping Enzyme
MDANVVSSSTIATYIDALAKNASELEQRSTAYEINNELELVFIKPPLITLTNVVNISTIQESFIRFTVTNKEGVKIRTKIPLS
KVHGLDVKNVQLVDAIDNIVWEKKSLVTENRLHKE[C,V,A,S]LLRLSTEERHIFLDYKKYGSSIRLELVNLIQAKTKNFTI
DFKLKYFLGSGAQSKSSLLHAINHPKSRPNTSLEIEFTPRDNETVPYDELIKELTTLSRHIFMASPENVILSPPINAPIKTFM
LPKQDIVGLDLENLYAVTKTDGIPITIRVTSNGLY[C,V,A,S]YFTHLGYIIRYPVKRIIDSEVVVFGEAVKDKNWTVYLIK
LIEPVNAINDRLEESKYVESKLVDI[C,V,A,S]DRIVFKSKKYEGPFTTTSEVVDMLSTYLPKQPEGVILFYSKGPKSNIDF
KIKKENTIDQTANVVFRYMSSEPIIFGESSIFVEYKKFSNDKGFPKEYGSGKIVLYNGVNYLNNIY[C,V,A,S]LEYINTHN
EVGIKSVVVPIKFIAEFLVNGEILKPRIDKTMKYINSEDYYGNQHNIIVEHLRDQSIKIGDIFNEDKLSDVGHQYANNDKFRL
NPEVSYFTNKRTRGPLGILSNYVKTLLISMY[C,V,A,S]SKTFLDDSNKRKVLAIDFGNGADLEKYFYGEIALLVATDPDAD
AIARGNERYNKLNSGIKTKYYKFDYIQETIRSDTFVSSVREVFYFGKFNIIDWQFAIHYSFHPRHYATVMNNLSELTASGGKV
LITTMDGDKLSKLTDKKTFIIHKNLPSSENYMSVEKIADDRIVVYNPSTMSTPMTEYIIKKNDIVRVFNEYGFVLVDNVDFAT
IIERSKKFINGASTMEDRPSTRNFFELNRGAIK[C,V,A,S]EGLDVEDLLSYYVVYVFSKRGGGGGGC >D12, Vaccinia Virus Capping Enzyme
MDEIVKNIREGTHVLLPFYETLPELNLSLGKSPLPSLEYGANYFLQISRVNDLNRMPTDMLKLFTHDIMLPESDLDKVYEILK
INSVKYYGRSTKADAVVADLSARNKLFKRERDAIKSNNHLTENNLYISDYKMLTFDVFRPLFDFVNEKY[C,V,A,S]IIKLP
TLFGRGVIDTMRIY[C,V,A,S]SLFKNVRLLK[C,V,A,S]VSDSWLKDSAIMVASDV[C,V,A,S]KKNLDLFMSHVKSVT
KSSSWKDVNSVQFSILNNPVDTEFINKFLEFSNRVYEALYYVHSLLYSSMTSDSKSIENKHQRRLVKLLLGGGGGGC

Figure 6

>Chain D1-D12 fusion, Vaccinia Virus Capping Enzyme, linked via (GGGGS)₃ linker.

MDANVVSSSTIATYIDALAKNASELEQRSTAYEINNELELVFIKPPLITLTNVVNISTIQESFIRFTVTNKEGVKIRTKIPLS
KVHGLDVKNVQLVDAIDNIVWEKKSLVTENRLHKE[C,V,A,S]LLRLSTEERHIFLDYKKYGSSIRLELVNLIQAKTKNFTI
DFKLKYFLGSGAQSKSSLLHAINHPKSRPNTSLEIEFTPRDNETVPYDELIKELTTLSRHIFMASPENVILSPPINAPIKTFM
LPKQDIVGLDLENLYAVTKTDGIPITIRVTSNGLY[C,V,A,S]YFTHLGYIIRYPVKRIIDSEVVVFGEAVKDKNWTVYLIK
LIEPVNAINDRLEESKYVESKLVDI[C,V,A,S]DRIVFKSKKYEGPFTTTSEVVDMLSTYLPKQPEGVILFYSKGPKSNIDF
KIKKENTIDQTANVVFRYMSSEPIIFGESSIFVEYKKFSNDKGFPKEYGSGKIVLYNGVNYLNNIY[C,V,A,S]LEYINTHN
EVGIKSVVVPIKFIAEFLVNGEILKPRIDKTMKYINSEDYYGNQHNIIVEHLRDQSIKIGDIFNEDKLSDVGHQYANNDKFRL
NPEVSYFTNKRTRGPLGILSNYVKTLLISMY[C,V,A,S]SKTFLDDSNKRKVLAIDFGNGADLEKYFYGEIALLVATDPDAD
AIARGNERYNKLNSGIKTKYYKFDYIQETIRSDTFVSSVREVFYFGKFNIIDWQFAIHYSFHPRHYATVMNNLSELTASGGKV
LITTMDGDKLSKLTDKKTFIIHKNLPSSENYMSVEKIADDRIVVYNPSTMSTPMTEYIIKKNDIVRVFNEYGFVLVDNVDFAT
IIERSKKFINGASTMEDRPSTRNFFELNRGAIK[C,V,A,S]EGLDVEDLLSYYVVYVFSKRGGGGSGGGGSGGGGSMDEIVK
NIREGTHVLLPFYETLPELNLSLGKSPLPSLEYGANYFLQISRVNDLNRMPTDMLKLFTHDIMLPESDLDKVYEILKINSVKY
YGRSTKADAVVADLSARNKLFKRERDAIKSNNHLTENNLYISDYKMLTFDVFRPLFDFVNEKY[C,V,A,S]IIKLPTLFGRG
VIDTMRIY[C,V,A,S]SLFKNVRLLK[C,V,A,S]VSDSWLKDSAIMVASDV[C,V,A,S]KKNLDLFMSHVKSVTKSSSWK
DVNSVQFSILNNPVDTEFINKFLEFSNRVYEALYYVHSLLYSSMTSDSKSIENKHQRRLVKLLLGGGGGGC

>Chain D12-D1 fusion, Vaccinia Virus Capping Enzyme, linked via $(GGGGS)_3$ linker.

MDEIVKNIREGTHVLLPFYETLPELNLSLGKSPLPSLEYGANYFLQISRVNDLNRMPTDMLKLFTHDIMLPESDLDKVYEILK
INSVKYYGRSTKADAVVADLSARNKLFKRERDAIKSNNHLTENNLYISDYKMLTFDVFRPLFDFVNEKY[C,V,A,S]IIKLP
TLFGRGVIDTMRIY[C,V,A,S]SLFKNVRLLK[C,V,A,S]VSDSWLKDSAIMVASDV[C,V,A,S]KKNLDLFMSHVKSVT
KSSSWKDVNSVQFSILNNPVDTEFINKFLEFSNRVYEALYYVHSLLYSSMTSDSKSIENKHQRRLVKLLLGGGGSGGGGSGGG
GSMDANVVSSSTIATYIDALAKNASELEQRSTAYEINNELELVFIKPPLITLTNVVNISTIQESFIRFTVTNKEGVKIRTKIP
LSKVHGLDVKNVQLVDAIDNIVWEKKSLVTENRLHKE[C,V,A,S]LLRLSTEERHIFLDYKKYGSSIRLELVNLIQAKTKNF
TIDFKLKYFLGSGAQSKSSLLHAINHPKSRPNTSLEIEFTPRDNETVPYDELIKELTTLSRHIFMASPENVILSPPINAPIKT
FMLPKQDIVGLDLENLYAVTKTDGIPITIRVTSNGLY[C,V,A,S]YFTHLGYIIRYPVKRIIDSEVVVFGEAVKDKNWTVYL
IKLIEPVNAINDRLEESKYVESKLVDI[C,V,A,S]DRIVFKSKKYEGPFTTTSEVVDMLSTYLPKQPEGVILFYSKGPKSNI
DFKIKKENTIDQTANVVFRYMSSEPIIFGESSIFVEYKKFSNDKGFPKEYGSGKIVLYNGVNYLNNIY[C,V,A,S]LEYINT
HNEVGIKSVVVPIKFIAEFLVNGEILKPRIDKTMKYINSEDYYGNQHNIIVEHLRDQSIKIGDIFNEDKLSDVGHQYANNDKF
RLNPEVSYFTNKRTRGPLGILSNYVKTLLISMY[C,V,A,S]SKTFLDDSNKRKVLAIDFGNGADLEKYFYGEIALLVATDPD
ADAIARGNERYNKLNSGIKTKYYKFDYIQETIRSDTFVSSVREVFYFGKFNIIDWQFAIHYSFHPRHYATVMNNLSELTASGG
KVLITTMDGDKLSKLTDKKTFIIHKNLPSSENYMSVEKIADDRIVVYNPSTMSTPMTEYIIKKNDIVRVFNEYGFVLVDNVDF
ATIIERSKKFINGASTMEDRPSTRNFFELNRGAIK[C,V,A,S]EGLDVEDLLSYYVVYVFSKRGGGGGGC

Figure 8

```
>         Cap-specific         nucleoside        2'-OH        methyltransferase
MDVVSLDKPFMYFEEIDNELDYEPESANEVAKKLPYQGQLKLLLGELFFLSKLQRHGILDGATVVYIGSAPGTHIRYLRDHFY
NLGVIIKWMLIDGRHHDPILNGLRDVTLVTRFVDEEYLRSIKKQLHPSKIILISDVRSKRGGNEPSTADLLSNYALQNVMISI
LNPVASSLKWRCPFPDQWIKDFYIPHGNKMLQPFAPSYSAEMRLLSIYTGENMRLTRVTKSDAVNYEKKMYYLNKIVRNKVVV
NFDYPNQEYDYFHMYFMLRTVYCNKTFPTTKAKVLFLQQSIFRFLNIPTTSTEKVSHEPIQRKISSKNSMSKNRNSKRSVRSN
K
```

Figure 13
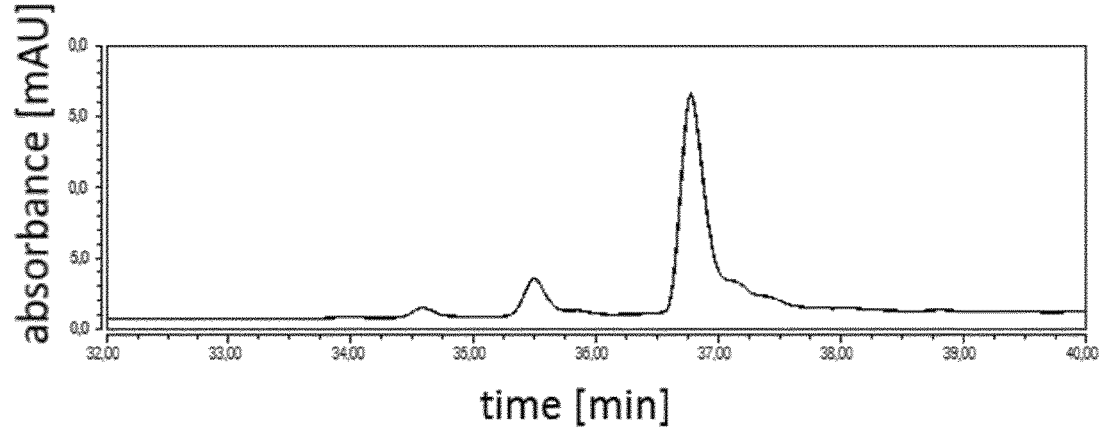
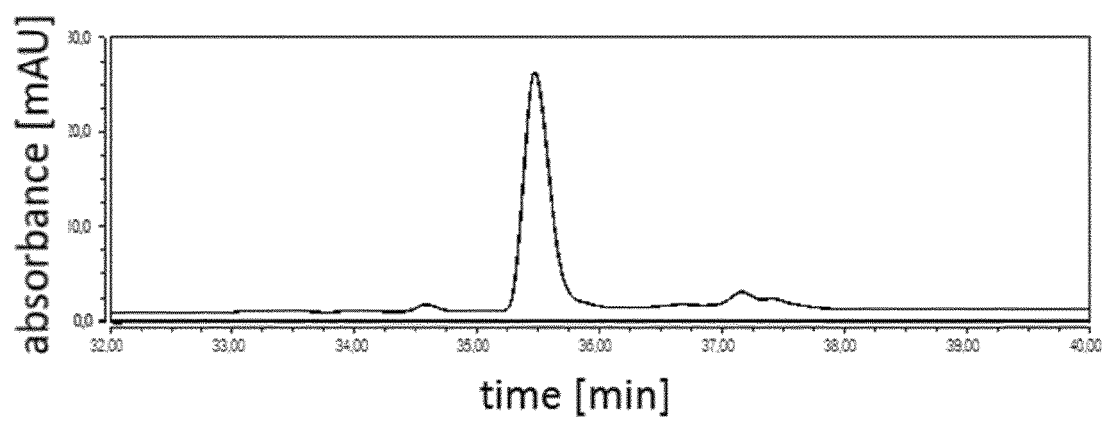

METHOD FOR ADDING CAP STRUCTURES TO RNA USING IMMOBILIZED ENZYMES

This application is a national phase application under 35 U.S.C. § 371 of International Application No. PCT/EP2016/062192, filed May 30, 2016, which claims benefit of International Application No. PCT/EP2015/062044, filed May 29, 2015, the entire contents of each of which are hereby incorporated by reference.

FIELD OF THE INVENTION

The present invention relates to an immobilized capping enzyme, preferably an immobilized Vaccinia virus capping enzyme. Furthermore, the present invention relates to an immobilized cap-specific nucleoside 2'-O-methyltransferase, preferably an immobilized Vaccinia virus cap-specific nucleoside 2'-O-methyltransferase. Moreover, the present invention relates to a method for immobilizing said enzymes and to a method of using said enzymes for the addition of a 5'-cap structure to RNAs. Moreover, the present invention relates to an enzyme reactor for performing the capping reaction using said immobilized enzymes and the subsequent separation of the 5'-capped RNA product. In addition, the present invention relates to a kit comprising the capping enzyme and/or the cap-specific nucleoside 2'-O-methyltransferase.

BACKGROUND OF THE INVENTION

Therapeutic ribonucleic acid (RNA) molecules represent a promising class of drugs. RNA-based therapeutics include mRNA molecules encoding antigens for use as vaccines (Fotin-Mleczek et al. (2012) J. Gene Med. 14(6): 428-439). In addition, it is envisioned to use RNA molecules for replacement therapies, e.g. providing missing proteins such as growth factors or enzymes to patients (Karikó et al. (2012) Mol. Ther. 20(5):948-953; Kormann et al. (2012) Nat. Biotechnol. 29(2):154-157). Furthermore, the therapeutic use of noncoding immunostimulatory RNA molecules (Heidenreich et al. (2014) Int J Cancer. December 21. doi: 10.1002/ijc.29402) and other non-coding RNAs such as microRNAs and long noncoding RNAs is considered (Esteller (2011) Nat. Rev. Genet. 15 12(12):861-74).

RNA-based therapeutics exhibit some superior properties over DNA cell transfection. As generally known, transfection of DNA molecules may lead to serious problems. E.g. application of DNA molecules bears the risk that the DNA integrates into the host genome. Integration of foreign DNA into the host genome can have an influence on the expression of host genes and possibly triggers expression of an oncogene or destruction of a tumor suppressor gene. Furthermore, a gene—and therefore the gene product—which is essential to the host may also be inactivated by integration of the foreign DNA into the coding region of this gene. Nevertheless, DNA still represents an important tool, even though some risks are associated with the application of DNA.

These risks do not occur if RNA, particularly mRNA, is used instead of DNA. An advantage of using RNA rather than DNA is that no virus-derived promoter element has to be administered in vivo and no integration into the genome may occur. Furthermore, the RNA does not have to overcome the barrier to the nucleus.

Short RNA molecules can be synthesized by chemical methods whereas long RNAs are typically produced by in vitro transcription reactions containing a suitable DNA template with a bacteriophage-derived promoter, an RNA polymerase, for example bacteriophage SP6, T3 or T7 RNA polymerase and ribonucleoside triphosphates (NTPs). 3' Poly-A tails as well as 5' cap structures can also be introduced into in vitro transcribed RNA (Pascolo S. (2006) Methods Mol Med. 127:23-40.).

The 5' terminal $m^7G$ cap present on most eukaryotic mRNAs promotes translation in vitro at the initiation level. For most mRNAs, elimination of the cap structure causes a loss of stability, especially against exonuclease degradation, and a decrease in the formation of the initiation complex of mRNAs for protein synthesis.

Currently, a co-transcriptional approach using viral RNA polymerase primed with cap analogues (e.g., $m^7G(5')ppp(5')G$) is widely used for the in vitro synthesis of capped RNAs. Di-nucleotide cap analogues are non-natural substrates for RNA polymerases, but can be incorporated by the enzymes at the 5' end of the nascent RNA, if an excess of cap analogue over the natural starting nucleotide GTP is used in the in vitro transcription reaction. The proportion of capping can be to some extent controlled by the ratio of cap analogue to GTP. However, since GTP is always present in the in vitro RNA transcription reaction, a certain proportion of the generated RNA species will start with the standard GTP, resulting in a triphosphate rather than a cap structure at the 5' end. Moreover, conventional cap analogues are commonly incorporated in two different orientations, forward orientation and reverse orientation. A cap in forward orientation (7-methylguanosine linked via an inverted 5'-5'-triphosphate to the initiating nucleoside of the transcript) is thought to be beneficial for the translation efficiency of the mRNA. The use of expensive Anti-Reverse cap Analog (ARCA, Ambion) reagent eliminates that problem; however, it further increases the production costs for the capped mRNA substantially. Both conventional cap analogues and ARCA analogue are major cost factors, especially for the large-scale industrial production of an mRNA medicament. Moreover, co-transcriptional capping using cap-analogues may result in decreased mRNA yields in in vitro transcription (Konarska et al. (1984) Cell 38(3): 731-736).

Besides co-transcriptional capping of mRNA that consumes expensive cap analogues, enzymatic capping of RNA is performed in the art. Suitable enzymes or enzyme complexes present in all eukaryotes and some viruses execute three activities (RNA 5' triphosphatase (TPase), RNA-guanylyltransferase (GTase), and RNA(guanine-N7)-methyltransferase (MTase). The vaccinia virus capping enzyme is a heterodimer of two polypeptides (D1-D12) executing all three steps of $m^7GpppRNA$ synthesis. Therefore, vaccinia virus capping enzyme has been widely used as an enzyme for capping RNAs in vitro. In the presence of a methyl donor (S-adenosylmethionine) and GTP, enzymatic capping is facilitated with high efficiency in the naturally occurring forward orientation, resulting in the generation of a cap0 structure ($m^7GpppNp$-RNA).

Cap-specific nucleoside 2'-O-methyltransferase enzyme creates a canonical 5'-5'-triphosphate linkage between the 5'-terminal nucleotide of an mRNA and a guanine cap nucleotide wherein the cap guanine contains an N7 methylation and the 5'-terminal nucleotide of the mRNA contains a 2'-O-methyl. Such a structure is termed the cap1 structure ($m^7GpppNmp$-RNA). It has been reported that this cap1 structure may result in a higher translational-competency (Kuge et al. (1998) Nucl. Acids Res. 26(13): 3208-3214.) and cellular stability and a reduced activation of cellular pro-inflammatory cytokines, as compared, e.g., to other 5' cap analog structures known in the art (Decroly et al. (2012) Nature Reviews Microbiology 10(1): 51-65).

Several problems in respect of large-scale RNA production emerge if capping of RNA is performed post-transcriptionally by capping enzymes. One problem is that enzymes should be removed from the final capped mRNA product by purification methods. Such purification methods have to include the inactivation or denaturation of capping enzyme after enzymatic reactions occurred. Therefore, another problem is that for every RNA batch, new capping enzyme has to be used, which is very cost-intensive.

In summary, the procedures currently performed in the art to generate 5' terminal cap mRNA are very cost-intensive. Cap analogues for in vitro transcription as well as capping enzymes for post-transcriptional cap synthesis (capping enzymes and cap-specific nucleoside 2'-O-methyltransferases) represent major cost-factors in large scale industrial production of mRNA. Furthermore, using the co-transcriptional approach, a high proportion of RNA is either not capped or comprises a 5'-cap in the wrong orientation. Therefore, only the RNA comprising a 5'-cap structure in the right orientation acts as active ingredient. Moreover, generating RNAs with a cap1 structure may even increase the translation efficacy, but requires a further enzymatic step in the production process.

In summary, there is a need for alternative approaches for generating 5' capped RNAs, preferably RNAs with a cap1 structure, useful for pharmaceutical purposes in a cost-efficient manner.

The problem underlying the present invention is solved by the claimed subject-matter.

SUMMARY OF THE INVENTION

A solution of these problems is an immobilized capping enzyme, preferably immobilized vaccinia virus (VV) capping enzyme, preferably used in an enzyme reactor. The present invention is particularly suitable for enhancing and improving the post-transcriptional synthesis of 5' capped RNAs, particularly for the large scale production of in vitro transcribed RNA. The disclosed capping enzyme allows controlled RNA capping in a bio-reactor, producing cap0 structures. Moreover, immobilized cap-specific nucleoside 2'-O-methyltransferase can be integrated into the enzyme reactor to generate cap1 structures, preferably in a separate module.

An advantage of the enzyme reactor is that immobilized capping enzymes and cap-specific nucleoside 2'-O-methyltransferase in the reactor/reactor modules can be re-used for several cycles which additionally decreases the costs of enzymes used in the manufacturing process.

The present invention is particularly suitable for enhancing and improving the post-transcriptional synthesis of 5' cap structures, i.e. cap0 or cap1 structures, on RNAs, particularly for the large scale production of in vitro transcribed RNA. The disclosed capping device allows controlled RNA capping in a bio-reactor, preferably consisting of a module to generate cap0 structures by using immobilized capping enzymes and a module that generates cap1 by using immobilized cap-specific nucleoside 2'-O-methyltransferase. Another advantage is that immobilized enzymes can be re-used for several cycles which additionally decrease the manufacturing costs for capped RNAs. The immobilization of capping enzyme and cap-specific nucleoside 2'-O-methyltransferase provides an excellent base for increasing availability of enzyme to the naked RNA substrate with greater turnover over a considerable period of time. Therefore, the capping procedure performed in the capping reactor modules is more time-efficient than the batch process commonly used in the art. Furthermore, the herein disclosed immobilization strategies for capping enzyme and cap-specific nucleoside 2'-O-methyltransferase may stabilize structure, activities and stability. Immobilization of capping enzyme and cap-specific nucleoside 2'-O-methyltransferase may therefore also improve the overall efficiency of the enzymatic capping reaction.

Summarizing the above, such a capping reactor meets industrial demands for large-scale production of capped RNA, e.g. in vitro transcribed mRNA, as it is more economic (e.g., less consumption of enzymes, generation of cap1 structures, no need of expensive ARCA cap analogues, less purification steps necessary to remove enzymes after reaction, lower doses of RNA are necessary because all RNA molecules are functional), more ecologic (e.g., less consumption of chemicals for purification needed) and more controllable (e.g., automated capping process is less prone for human errors). Systems and methods of making and using such an RNA capping reactor and methods for generating immobilized capping enzyme and immobilized cap-specific nucleoside 2'-O-methyltransferase used in the capping reactor modules are provided in this invention.

Accordingly, the present invention relates to a capping enzyme being immobilized onto a solid support by covalent binding, entrapment, encapsulation or physical adsorption.

The present invention also relates to a solid support onto which a capping enzyme is immobilized.

Preferably, the capping enzyme is immobilized onto said solid support by covalent binding, more preferably to a thiol-activated solid support, haloacetyl functionalized solid support, pyridyl disulfide-functionalized solid support, epoxy-activated solid support, maleimide-activated solid support or a mixture thereof.

In a preferred embodiment, the capping enzyme is immobilized via at least one thiol group, and/or amine group, and/or hydroxyl group.

Also preferably, the capping enzyme is immobilized via a thiol group of at least one cysteine residue.

Also preferably, the covalent binding is a disulfide bridge or a thioether bond.

In a further preferred embodiment the solid support comprises a material selected from the group consisting of Sepharose™, thiopropyl-Sepharose™, Sephadex™, agarose, silica, magnetic beads, methacrylate beads and nanoparticles and/or is selected from the group consisting of activated thiol Sepharose™, thiopropyl-Sepharose™, thiol-activated Sephadex™, thiol-activated agarose, silica-based thiol-activated matrix, silica-based thiol-activated magnetic beads, pyridyl disulfide-functionalized nanoparticles, epoxy methacrylate beads, maleimide-activated agarose and mixtures thereof.

In a preferred embodiment, the capping enzyme is immobilized onto an epoxy-activated support, preferably via a thiol group of at least one cysteine residue. The epoxy-activated support may be epoxy methacrylate beads.

Preferably, the capping enzyme has RNA triphosphatase (TPase), guanylyltransferase (GTase) and methyltransferase (MTase) activity independent of RNA polymerase II.

Also preferably, the capping enzyme is a heterodimer of a catalytic (D1 polypeptide) and a regulatory (D12 polypeptide) polypeptide. The capping enzyme may be immobilized via the regulatory polypeptide (D12 polypeptide).

In a further preferred embodiment the capping enzyme is from Vaccina Virus.

In another preferred embodiment the wild-type capping enzyme is composed of:
(i) a polypeptide comprising an amino acid sequence selected from the group consisting of SEQ ID NO: 1 and SEQ ID NOs: 61-97 or a functional variant thereof having at least 80% sequence identity to the amino acid sequence according to any one of SEQ ID NO: 1 and SEQ ID NOs: 61-97; and
(ii) a polypeptide comprising an amino acid sequence selected from the group consisting of SEQ ID NO: 2 and SEQ ID NOs: 98-127 or a functional variant thereof having at least 80% sequence identity to the amino acid sequence according to any one of SEQ ID NO:2 and SEQ ID NOs: 98-127.

More preferably, the wild-type capping enzyme is composed of:
(i) a polypeptide comprising the amino acid sequence according to SEQ ID NO: 1 or a functional variant thereof having at least 80% sequence identity to the amino acid sequence according to SEQ ID NO: 1; and
(ii) a polypeptide comprising the amino acid sequence according to SEQ ID NO: 2 or a functional variant thereof having at least 80% sequence identity to the amino acid sequence according to SEQ ID NO:2.

Most preferably, the wild-type capping enzyme is composed of:
(i) a polypeptide comprising the amino acid sequence according to SEQ ID NO: 1; and
(ii) a polypeptide comprising the amino acid sequence according to SEQ ID NO: 2.

Preferably, the capping enzyme comprises at least one newly introduced cysteine residue compared to the wild-type capping enzyme and more preferably the newly introduced cysteine residue is attached to the C terminus of the capping enzyme, preferably via a linker. Suitable linker sequences comprising a C-terminal cysteine are depicted in SEQ ID NOs: 15 to 39.

Also preferably the capping enzyme comprises only one cysteine residue or is mutated to comprise only one cysteine residue and more preferably the only one cysteine residue is a newly introduced cysteine residue which is even more preferably attached to the C terminus of the capping enzyme, preferably via a linker.

According to a preferred embodiment the capping enzyme comprises a polypeptide comprising the amino acid sequence according to any one of SEQ ID NOs: 2, 4, 5 and 298-327 or a functional variant thereof having at least 80% sequence identity to the amino acid sequence according to any one of SEQ ID NOs: 2, 4, 5 and 298-327 and more preferably it further comprises a polypeptide comprising the amino acid sequence according to any one of SEQ ID NOs: 1, 6, 7 and 261-297 or a functional variant thereof having at least 80% sequence identity to the amino acid sequence according to any one of SEQ ID NOs: 1, 6, 7 and 261-297.

In another preferred embodiment the capping enzyme comprises the amino acid sequence according to any of SEQ ID NOs: 8, 9 and 10 or a functional variant thereof having at least 80% sequence identity to the amino acid sequence according to any of SEQ ID NOs: 8, 9 and 10.

The present invention also relates to a method for producing said capping enzyme or said solid support, comprising a step of
a) contacting said capping enzyme with a solid support under conditions suitable for immobilizing the capping enzyme to the solid support by covalent binding.

In a preferred embodiment step a) comprises the formation of a disulfide bridge or thioether bond. Most preferably, step a) comprises the formation of a thioether bond.

Preferably, step a) comprises the formation of a covalent bond between a cysteine residue of the capping enzyme and a thiol group, a haloacetyl group, a pyridyl disulfide, an epoxy group, or a maleimide group of the solid support.

Preferably, step a) comprises the formation of a covalent bond between a cysteine residue of the capping enzyme and an epoxy group of the solid support. More preferably, the solid support is epoxy methacrylate beads.

The present invention also relates to the use of a capping enzyme being immobilized onto a solid support or a solid support onto which a capping enzyme is immobilized for producing ribonucleic acid (RNA) molecules with 5' cap0 structures.

Preferably, the capping enzyme is defined as above.

Another aspect of the present invention relates to a method for producing capped ribonucleic acid (RNA) molecules, comprising a step of
i) contacting a capping enzyme being immobilized onto a solid support or a solid support onto which a capping enzyme is immobilized with RNA molecules, a nucleotide and a methyl donor, preferably S-adenosylmethionine, under conditions suitable for forming a 5'-cap0 structure.

Preferably, the capping enzyme is defined as above.
Also preferably the RNA is messenger RNA (mRNA).
Preferably, the method further comprises a step of
ii) converting the cap0 structure into a cap1 structure by contacting the RNA comprising a 5'-cap0 structure with a cap-specific nucleoside 2'-O-methyltransferase and a methyl donor.

More preferably the cap-specific nucleoside 2'-O-methyltransferase is immobilized onto a solid support and even more preferably it is immobilized onto said solid support by covalent binding.

Preferably, the cap-specific nucleoside 2'-O-methyltransferase is immobilized by covalent binding to a thiol-activated solid support, haloacetyl functionalized solid support, pyridyl disulfide-functionalized solid support, epoxy-activated solid support, maleimide-activated solid support or a mixture thereof.

In a preferred embodiment, the cap-specific nucleoside 2'-O-methyltransferase is immobilized via at least one thiol group, and/or amine group, and/or hydroxyl group.

Also preferably, the cap-specific nucleoside 2'-O-methyltransferase is immobilized via a thiol group of at least one cysteine residue.

Also preferably the covalent binding is a disulfide bridge or a thioether bond.

Preferably, the solid support is selected from the group consisting of Sepharose™, thiopropyl-Sepharose™, Sephadex™, agarose, silica, magnetic beads and nanoparticles and/or is selected from the group consisting of activated thiol Sepharose™, thiopropyl-Sepharose™, thiol-activated Sephadex™, thiol-activated agarose, silica-based thiol-activated matrix, silica-based thiol-activated magnetic beads, pyridyl disulfide-functionalized nanoparticles, epoxy methacrylate beads, maleimide-activated agarose and mixtures thereof.

Also preferably, the cap-specific nucleoside 2'-O-methyltransferase is immobilized to an epoxy-activated support, preferably via a thiol group of at least one cysteine residue. More preferably, the solid support is epoxy methacrylate beads.

Also preferably the wild-type cap-specific nucleoside 2'-O-methyltransferase comprises the amino acid sequence according to any one of SEQ ID NOs: 3 and 128-160 or a functional variant thereof having at least 80% sequence identity to the amino acid sequence according to any one of SEQ ID NOs: 3 and 128-160.

Preferably, the cap-specific nucleoside 2'-O-methyltransferase comprises at least one newly introduced cysteine residue compared to the wild-type cap-specific nucleoside 2'-O-methyltransferase and more preferably the newly introduced cysteine residue is attached to the C terminus of the cap-specific nucleoside 2'-O-methyltransferase, preferably via a linker. Suitable linker sequences comprising a C-terminal cysteine are depicted in SEQ ID NOs: 15 to 39.

Also preferably the cap-specific nucleoside 2'-O-methyltransferase comprises only one cysteine residue or is mutated to comprise only one cysteine residue. More preferably the only one cysteine residue is a newly introduced cysteine residue and even more preferably the newly introduced cysteine residue is attached to the C terminus of the cap-specific nucleoside 2'-O-methyltransferase, preferably via a linker. Suitable linker sequences comprising a C-terminal cysteine are depicted in SEQ ID NOs: 15 to 39.

In a preferred embodiment the cap-specific nucleoside 2'-O-methyltransferase comprises the amino acid sequence according to any one of SEQ ID NOs: 11, 12 and 328-360 or a functional variant thereof having at least 80% sequence identity to the amino acid sequence according to any one of SEQ ID NOs: 11, 12 and 328-360.

In a further preferred embodiment the method further comprises a step of
ii) isolating the capped RNA molecules by filtration or chromatography, wherein the filtration preferably comprises ultrafiltration and/or diafiltration.

More preferably the method further comprises a step of
iii) formulating the capped RNA for administration to a human subject.

In another aspect the present invention relates to an enzyme reactor comprising a capping enzyme as defined herein.

The enzyme reactor may further comprise a cap-specific nucleoside 2'-O-methyltransferase which may be immobilized and which may be the cap-specific nucleoside 2'-O-methyltransferase as defined herein.

The enzyme reactor may be divided into two modules, one module comprising the immobilized capping enzyme and one module comprising the immobilized cap-specific nucleoside 2'-O-methyltransferase.

The present invention also relates to the use of said enzyme reactor in a method for producing capped RNA molecules.

In another aspect the present invention relates to a capping enzyme comprising an amino acid sequence selected from the group consisting of:
a) the amino acid sequence according to any one of SEQ ID NOs: 4, 5, 198-227 and 298-327 or a functional variant thereof having at least 80% sequence identity to the amino acid sequence according to any one of SEQ ID NOs: 4, 5, 198-227 and 298-327
b) the amino acid sequence according to any one of SEQ ID NOs: 6, 7, 161-197 and 261-297 or a functional variant thereof having at least 80% sequence identity to the amino acid sequence according to any one of SEQ ID NOs: 6, 7, 161-197 and 261-297 and
c) the amino acid sequence according to any of SEQ ID NOs: 8, 9 and 10 or a functional variant thereof having at least 80% sequence identity to the amino acid sequence according to any of SEQ ID NOs: 8, 9 and 10.

In still another aspect the present invention relates to a cap-specific nucleoside 2'-O-methyltransferase being immobilized onto a solid support and to a solid support onto which a cap-specific nucleoside 2'-O-methyltransferase is immobilized.

Preferably the cap-specific nucleoside 2'-O-methyltransferase is immobilized onto said solid support by covalent binding, more preferably by covalent binding to a thiol-activated solid support, haloacetyl functionalized solid support, pyridyl disulfide-functionalized solid support, epoxy-activated solid support, maleimide-activated solid support or a mixture thereof.

Preferably, the cap-specific nucleoside 2'-O-methyltransferase is immobilized via a thiol group of at least one cysteine residue.

Also preferably, the covalent binding is a disulfide bridge or a thioether bond.

The solid support may comprise a material selected from the group consisting of Sepharose™, thiopropyl-Sepharose™, Sephadex™, agarose, silica, magnetic beads and nanoparticles and/or may be selected from the group consisting of activated thiol Sepharose™, thiopropyl-Sepharose™, thiol-activated Sephadex™, thiol-activated agarose, silica-based thiol-activated matrix, silica-based thiol-activated magnetic beads, pyridyl disulfide-functionalized nanoparticles, epoxy methacrylate beads, maleimide-activated agarose and mixtures thereof.

Preferably, the wild-type cap-specific nucleoside 2'-O-methyltransferase comprises the amino acid sequence according to any one of SEQ ID NOs: 3 and 128-160 or a functional variant thereof having at least 80% sequence identity to the amino acid sequence according to any one of SEQ ID NOs: 3 and 128-160.

Also preferably, the cap-specific nucleoside 2'-O-methyltransferase comprises at least one newly introduced cysteine residue compared to the wild-type cap-specific nucleoside 2'-O-methyltransferase, more preferably the newly introduced cysteine residue is attached to the C terminus of the cap-specific nucleoside 2'-O-methyltransferase, preferably via a linker.

Preferably, the cap-specific nucleoside 2'-O-methyltransferase comprises only one cysteine residue or is mutated to comprise only one cysteine residue and more preferably the only one cysteine residue is a newly introduced cysteine residue and even more preferably the newly introduced cysteine residue is attached to the C terminus of the cap-specific nucleoside 2'-O-methyltransferase, preferably via a linker.

Also preferably, the cap-specific nucleoside 2'-O-methyltransferase comprises the amino acid sequence according to any one of SEQ ID NOs: 11, 12, 228-260 and 328-360 or a functional variant thereof having at least 80% sequence identity to the amino acid sequence according to any one of SEQ ID NOs: 11, 12, 228-260 and 328-360.

The present invention also relates to a method for producing said cap-specific nucleoside 2'-O-methyltransferase, comprising a step of
a) contacting said cap-specific nucleoside 2'-O-methyltransferase with a solid support under conditions suitable for immobilizing the capping enzyme to the solid support by covalent binding, affinity binding, or physical adsorption.

Preferably, step a) comprises the formation of a disulfide bridge or thioether bond.

Also preferably, step a) comprises the formation of a covalent bond between a cysteine residue of the cap-specific nucleoside 2'-O-methyltransferase and a thiol group, a haloacetyl group, a pyridyl disulfide, an epoxy group, or a maleimide group of the solid support.

The solid support may be a thiol-activated solid support, haloacetyl functionalized solid support, pyridyl disulfide-functionalized solid support, epoxy activated solid support, or maleimide-activated solid support.

In another aspect the present invention relates to the use of a cap-specific nucleoside 2'-O-methyltransferase being immobilized onto a solid support for producing ribonucleic acid (RNA) molecules with 5' cap1 structures.

Preferably, the cap-specific nucleoside 2'-O-methyltransferase is defined as above.

Another embodiment relates to a method for producing ribonucleic acid (RNA) molecules with a cap1 structure, comprising the step of contacting RNA with a cap0 structure with a cap-specific nucleoside 2'-O-methyltransferase being immobilized to a solid support and a methyl donor under conditions suitable for forming the cap1 structure.

Preferably, the cap-specific nucleoside 2'-O-methyltransferase is defined as above.

The method may further comprise a step of
ii) isolating the capped RNA molecules by filtration or chromatography.

Preferably, the filtration comprises ultrafiltration and/or diafiltration.

The method may further comprise a step of
iii) formulating the capped RNA for administration to a human subject.

The present invention also relates to an enzyme reactor comprising a cap-specific nucleoside 2'-O-methyltransferase as defined above and to the use of said enzyme reactor in a method for producing ribonucleic acid (RNA) molecules with a cap1 structure.

The present invention also relates to a cap-specific nucleoside 2'-O-methyltransferase comprising the amino acid sequence according to any one of SEQ ID NOs: 11, 12, 228-260 and 328-360 or a functional variant thereof having at least 80% sequence identity to the amino acid sequence according to any one of SEQ ID NOs: 11, 12, 228-260 and 328-360.

The present invention also relates to a kit comprising a capping enzyme being immobilized onto a solid support, and/or a cap-specific nucleoside 2'-O-methyltransferase being immobilized onto a solid support, a reaction buffer, a methyl donor (SAM), nucleoside triphosphates. The kit may further comprise one or more of a nucleotide mixture (optionally comprising modified nucleotides), an RNA polymerase, and an RNA in vitro transcription buffer.

BRIEF DESCRIPTION OF THE DRAWINGS

The figures shown in the following are merely illustrative and shall describe the present invention in a further way. These figures shall not be construed to limit the present invention thereto.

Capping enzyme or nucleoside 2'-O-methyltransferases (protein) may be coupled by passive physical forces (A), by affinity capture (B) or by covalent bond (C) to a suitable support material (SM). As support materials, a planar surface (elongated rectangle), and two different globular supports are exemplified (round circle, triangle). (A): The coupling via physical adsorption (arrow) can occur on various, often random residues on a protein. Physical adsorption is based on weak physical intermolecular interactions including electrostatic, hydrophobic, van der Waals, and hydrogen bonding interactions. (B): The coupling via affinity, comprising bio-affinity, can occur on specified positions on a protein. Bio-affinity immobilization is based on strong interactions of two biomolecules, where one partner of the interaction is fused to the protein (square), and one partner is coated on the respective support material (circle). (C): The coupling via covalent bond (bar-bell) can occur via specific reactive residues on a protein. Covalent bond is a strong chemical bond. Reactive residues on the protein and reactive groups on the support material have to be present to form covalent bonds FIG. 2 Ribbon representation of the full length VV capping enzyme Vaccinia virus capping enzyme ribbon representation that shows separate domains like TPase (RNA 5'-triphosphatase), GTase (RNA guanylyltransferase), Ntase (nucleotidyltransferase) and Mtase (AdoMet:RNA(guanine-N7)-methyltransferase) activities, located on the D1 polypeptide ("catalytic polypeptide"). The heterodimeric partner D12 ("regulatory polypeptide") is circumscribed by dashed lines. The regulatory polypeptide D12 is allosterically stimulating the MTase activity of the catalytic polypeptide D1. Figure adapted from Kyrieleis, Otto J P, et al. "Crystal structure of vaccinia virus mRNA capping enzyme provides insights into the mechanism and evolution of the capping apparatus." *Structure* 22.3 (2014): 452-465.

Figure 3:
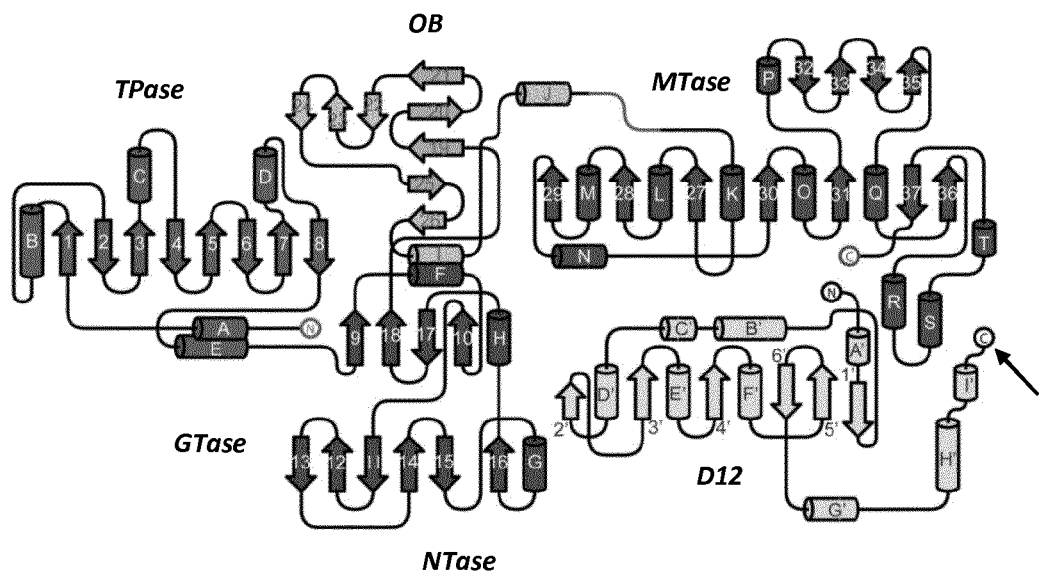

FIG. 3 Schematic topology diagram of the full length VV capping enzyme

Schematic topology diagram of the full length VV capping enzyme. TPase, GTase, Ntase and Mtase activities located on the D1 polypeptide are indicated and colored in different greyscales. Secondary structure elements are labelled. The accessible C-terminus of the heterodimeric partner D12 is highlighted by an arrow. Figure taken from Kyrieleis, Otto J P, et al. "Crystal structure of Vaccinia virus mRNA capping enzyme provides insights into the mechanism and evolution of the capping apparatus." *Structure* 22.3 (2014): 452-465.

Figure 4:
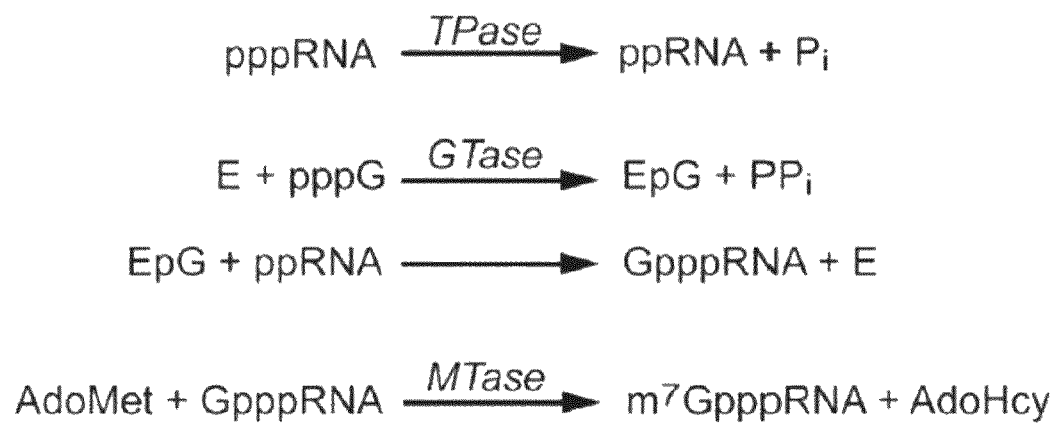

FIG. 4 Capping entails three enzymatic reactions, TPase, GTase, and MTase

The 5'-triphosphate end of the pre-mRNA is first hydrolyzed to a diphosphate by RNA 5'-triphosphatase (TPase). The diphosphate RNA is then capped with guanosine monophosphate (GMP) by RNA guanylyltransferase (GTase) via a two-step mechanism in which (1) GTase reacts with guanosine triphosphate (GTP) to form a covalent enzyme-(lysyl-Nz)-GMP intermediate and inorganic pyrophosphate (PPi), (2) GMP is transferred from GTase to the 5'-diphosphate RNA (ppRNA) end to form GpppRNA. Finally, the GpppRNA cap is converted to a 7-methyl guanosine RNA cap (m7GpppRNA) by AdoMet:RNA(guanine-N7)-methyltransferase (MTase), resulting in a cap0 structure. The ribose of the adjacent nucleoside may also enzymatically methylated, e.g. by cap-specific nucleoside 2'-O-methyltransferases to give a cap1.

FIG. 5 Mutated protein sequence of the VV capping enzyme polypeptides D1 and D12

Sequences of capping enzyme heterodimeric partners D1 (catalytic polypeptide) and D12 (regulatory polypeptide) are shown, with relevant residues highlighted (native cysteine, mutated residues). For each highlighted residue, either the native cysteine can be maintained, or may be substituted with another amino acid, preferably with V, A, or S. Moreover, an additional cysteine may be introduced at the C-terminus, preferably via a glycine rich linker. Most preferably, the mutant protein will only retain one cysteine residue (used for covalent coupling to the support).

FIG. 6 Fusion protein sequence of the VV capping enzyme D1-D12 and D12-D1 fusion proteins Exemplary D1-D12 and D12-D1 fusion proteins with potential residue changes (compare with FIG. 5). As linker element between both polypeptide chains, any linker element may be used (Chen et al. (2010) BioTechniques 49(1): 513). As an example, a (GGGS)$_3$ linker is illustrated. Examples of further suitable linkers are also depicted in SEQ ID NOs: 361-385.

Figure 7:
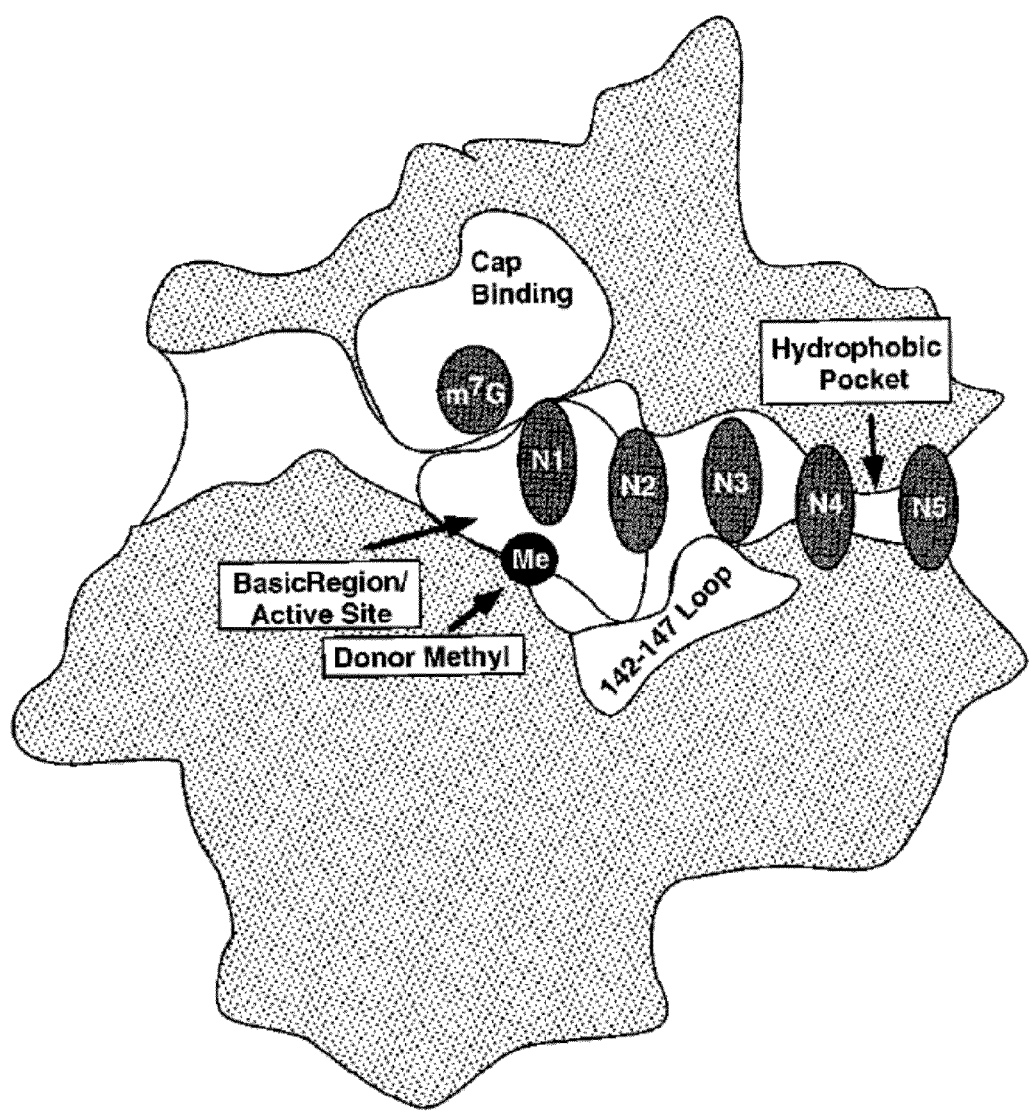

FIG. 7 Schematic showing a model for the binding of a capped RNA strand to the cleft and 2'-O-methyltransferase active site Schematic of a Vaccinia Virus cap-specific nucleoside 2'-O-methyltransferase. Important regions of the surface (dashed area) are labeled, including putative binding site for the terminal (m7G) nucleotide of cap0 (cap binding) RNA molecules; the position at which the donor methyl protrudes into the cleft (donor methyl); the active site and associated basic region (basic region/active site); the hydrophobic pocket at the distal end of the cleft. RNA nucleotides are represented by dark ovals, and consecutively numbered (N1, N2 . . . ). Drawing taken from Hodel, Alec E., et al. Cell 85.2 (1996): 247-256.

FIG. 8 Mutated protein sequences of the cap-specific nucleoside 2'-O-methyltransferase enzyme Sequence of cap-specific nucleoside 2'-O-methyltransferase with relevant residues highlighted (native cysteine, mutated residues). For each highlighted residue, either the native cysteine can be maintained, or may be substituted with another amino acid, preferably with V, A, or S. Moreover, an additional cysteine may be introduced at the C-terminus, preferably via a glycine rich linker. Most preferably, the mutant protein will retain only one cysteine residue (used for covalent coupling to the support).

Figure 9:
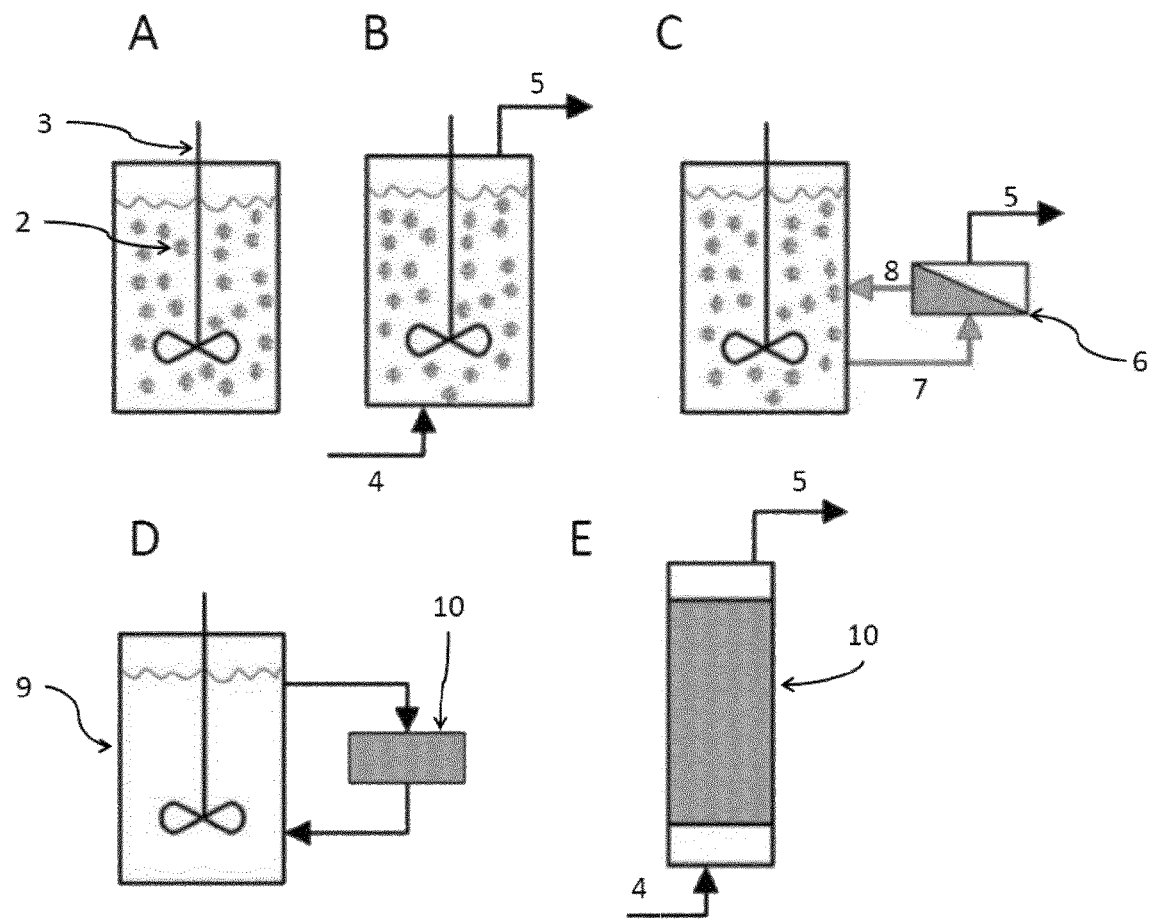

FIG. 9 Examples of different configurations for enzyme reactors containing immobilized capping enzyme and/or cap-specific nucleoside 2'-O-methyltransferase (A) Stirred-tank batch reactors, (B) Continuous (stirred-tank) batch reactors (FIG. 10B) (C) stirred tank-ultrafiltration reactor (D) Recirculation batch reactors (E) Continuous packed bed reactors. Different components of the reactor types are indicated: (1) reactor vessel, (2) immobilized enzyme, (3) stirrer, (4) inlet, (5) outlet, (6) ultrafiltration device (diagonal line: ultrafiltration membrane), (7) feed tube for ultrafiltration device, (8) recirculation tube, (9) substrate/buffer tank, (10) packed bed tank, containing enzymes. Figure adapted from (Illanes, Andrés, ed. Enzyme biocatalysis: principles and applications. Springer Science & Business Media, 2008).

Figure 10:
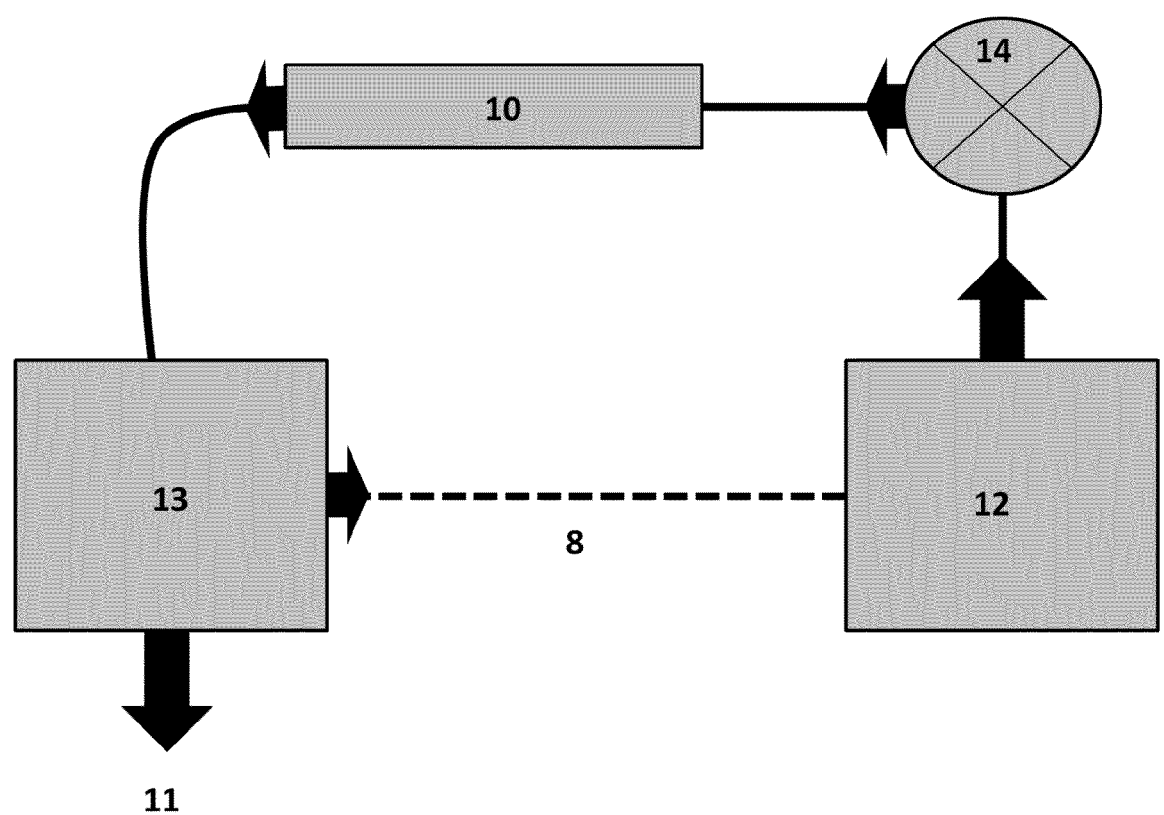

FIG. 10 Drawing of an enzyme reactor generating cap0 and/or cap1 RNAs

The Thiol Sepharose™4B HiTrap column with immobilized capping enzyme and/or immobilized 2'-O-methyltransferase (10) is connected to an input tank (e.g., a feed module) (12) and an output tank (e.g., a capture module) (13). The flow is adjusted using a peristaltic pump (14). Moreover, the output-tank is connected to the input-tank to optionally facilitate continuous flow in a closed system (optional re-circulation pipeline (8), dashed line, only opened if quality control is not complying to the pre-defined standards), capped RNA product (11) is subjected to quality controls and/or ultrafiltration methods and purification methods.

Figure 11:
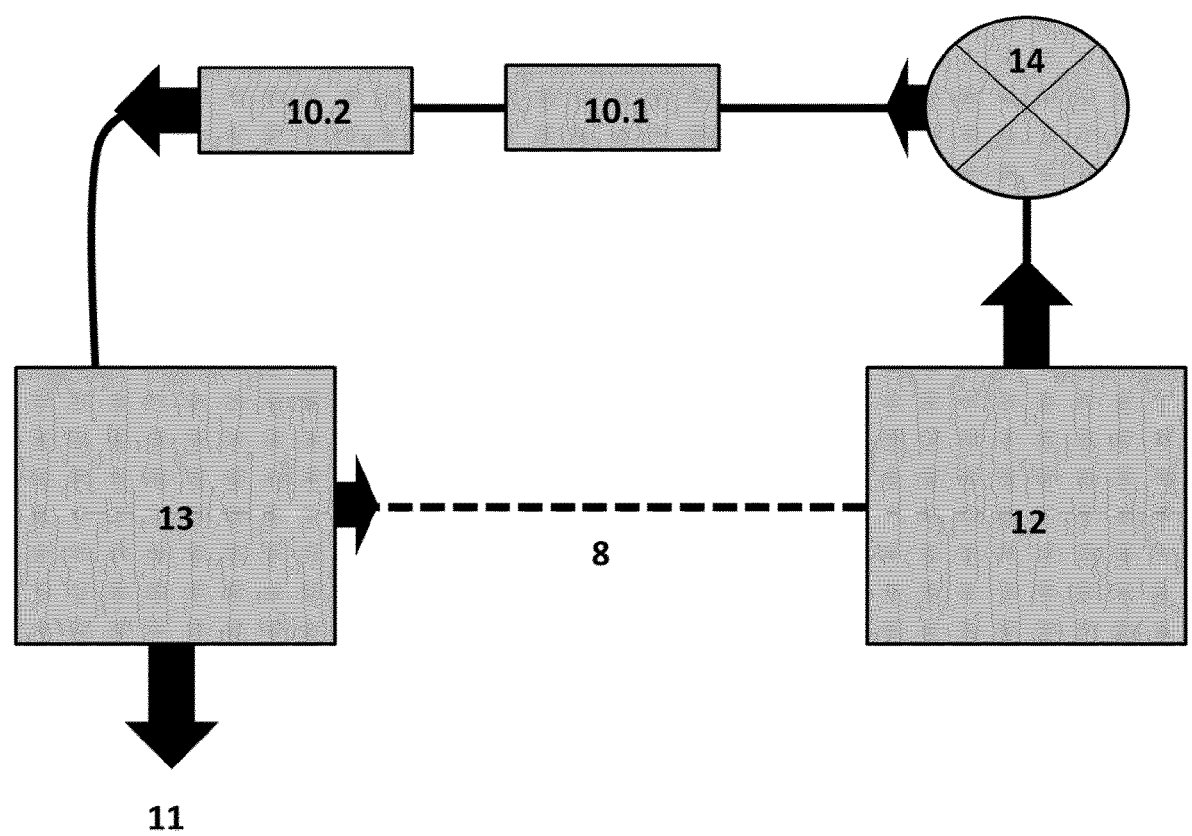

FIG. 11: Modular arrangement of the cap1-reactor.

The capping module with immobilized capping enzyme (10.1) is connected to a cap1 module with immobilized cap-specific nucleoside 2'-O-methyltransferase (10.2). The modules are connected to an an input tank (e.g., a feed module) (12) and an output tank (e.g., a capture module) (13). The flow is adjusted using a peristaltic pump (14). Moreover, the output-tank is connected to the input-tank to optionally facilitate continuous flow in a closed system (optional re-circulation pipeline (8), dashed line, only opened if quality control is not complying to the pre-defined standards, that is not properly capped RNA). Capped RNA product (11) is subjected to quality controls and/or ultrafiltration methods and purification methods.

Figure 12:
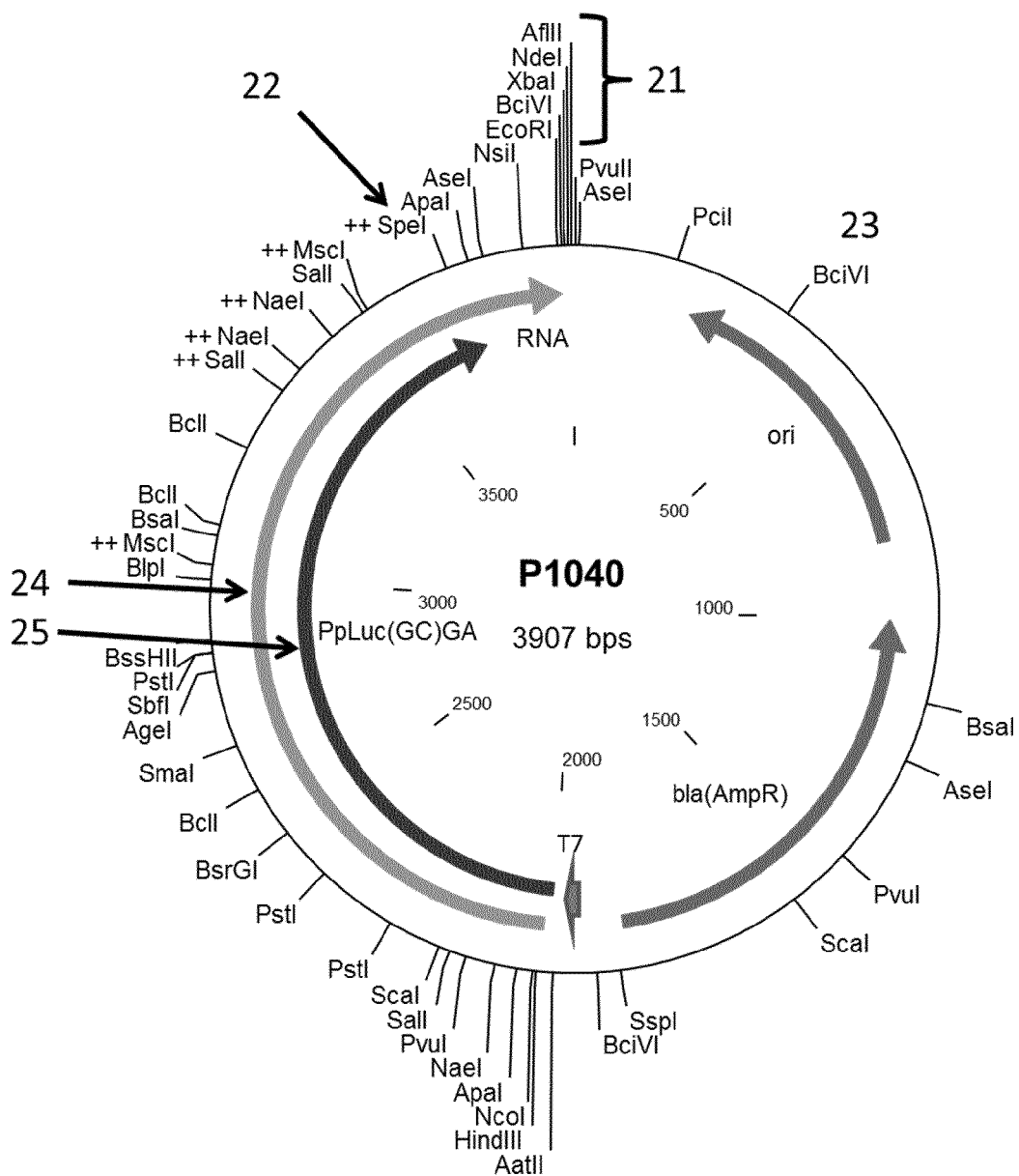

FIG. 12: Plasmid map of the vector used in the examples

Plasmid map (derived from the commercially available puc19) of P1040, encoding for PpLuc. Restriction sites are indicated. Important elements of the plasmid DNA are indicated. (21) Enzymes that can potentially be used to linearize the plasmid, generating a linear template DNA for in vitro transcription of RNA. (22) SpeI can also be used to generate a linear template DNA for RNA in vitro transcription of RNA, resulting in an RNA product without Poly-A, Poly-C and histone stem loop. (23) BciVI can also be used for linearization, even though that enzyme is not a single cutter. (24) Insert PpLuc, cloned via SpeI and HindIII sites into the vector. (25) PpLuc (GC)GA-A64-C30-histone-stem-loop template for RNA in vitro transcription, using T7 polymerase. The nucleotide sequence of P1040 is depicted in SEQ ID NO: 13.

FIG. 13: HPLC analysis of 10mer RNA after capping with soluble VV capping enzyme The figure shows the HPLC analysis of un-capped RNA 10mer (A) and the HPLC analysis of capped RNA 10mer using soluble VV capping enzyme (B). The figure shows that capped and un-capped RNA can be distinguished using the HPLC method. Capped RNA is eluted earlier from the HPLC column than untreated RNA. For a detailed description of the experiment see Example 1.

Figure 14:
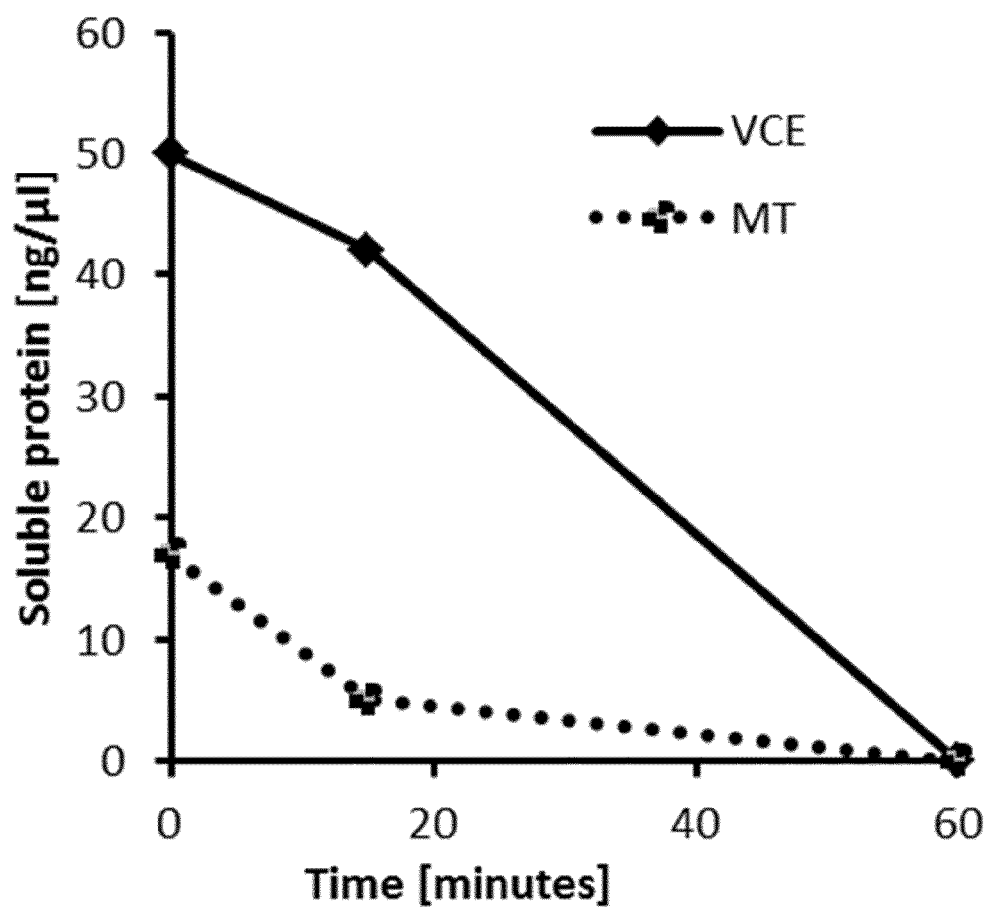

FIG. 14: Protein concentration in the supernatant of immobilization reactions

The figure shows that Vaccinia Virus capping enzyme and cap-specific nucleoside 2'-O-methyltransferase were efficiently immobilized using epoxy methacrylate solid supports. Shown is an analysis of the protein concentration of supernatant samples taken during the immobilization procedure of Vaccinia Virus capping enzyme (VVCE) and cap-specific nucleoside 2'-O-methyltransferase (MT). After 60 minutes, no relevant protein levels could be detected, suggesting that the immobilization of both enzymes was successful. For a detailed description of the experiments, see Example 2 (capping enzyme immobilization) and Example 3 (cap-specific nucleoside 2'-O-methyltransferase immobilization).

Figure 15:
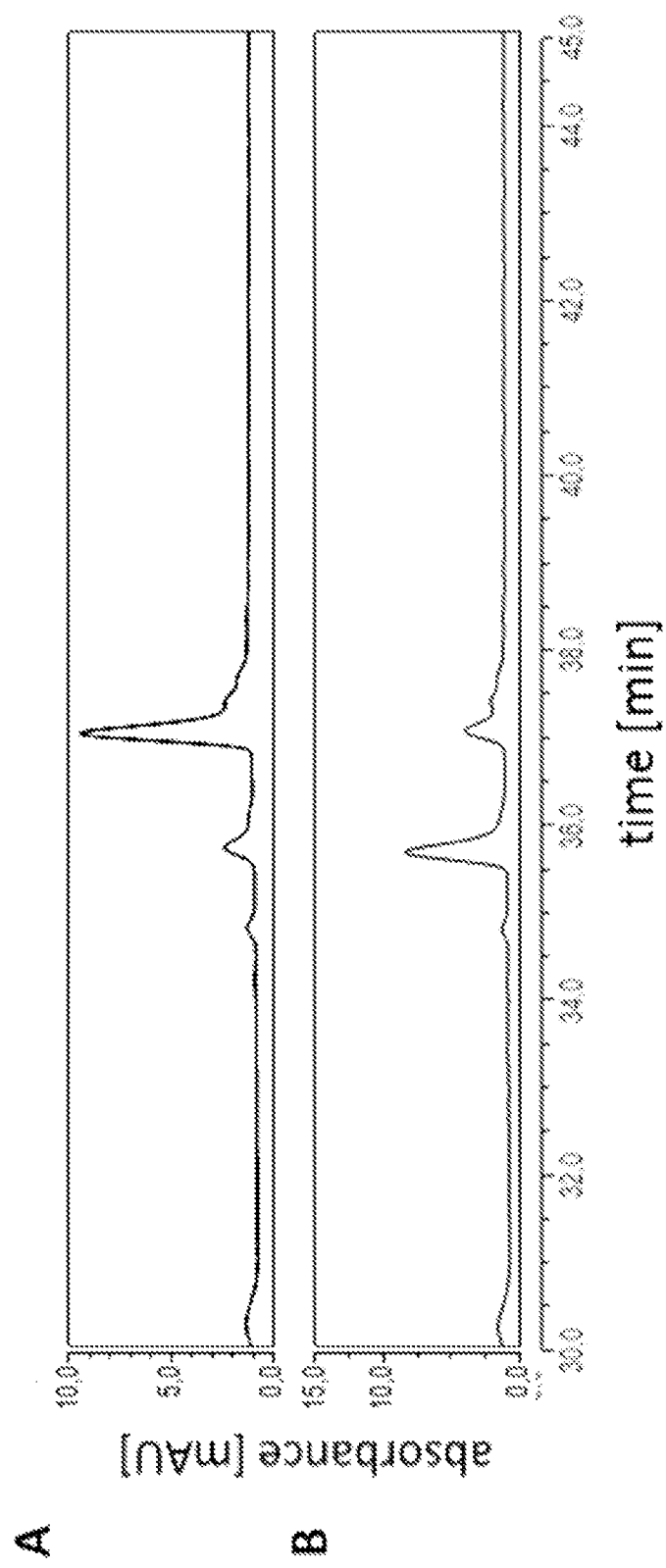

FIG. 15: HPLC analysis of 10mer RNA after capping with immobilized VV capping enzyme The figure shows the HPLC analysis of un-capped RNA 10mer (A) and the HPLC analysis of capped RNA 10mer using immobilized VV capping enzyme (B). The figure shows the HPLC analysis of enzymatic activity of immobilized VVCE. In B, the dominant peak represents capped RNA revealing strong enzymatic capping efficiency of the immobilized VVCE. For a detailed description of the experiment see Example 2.

Figure 16:
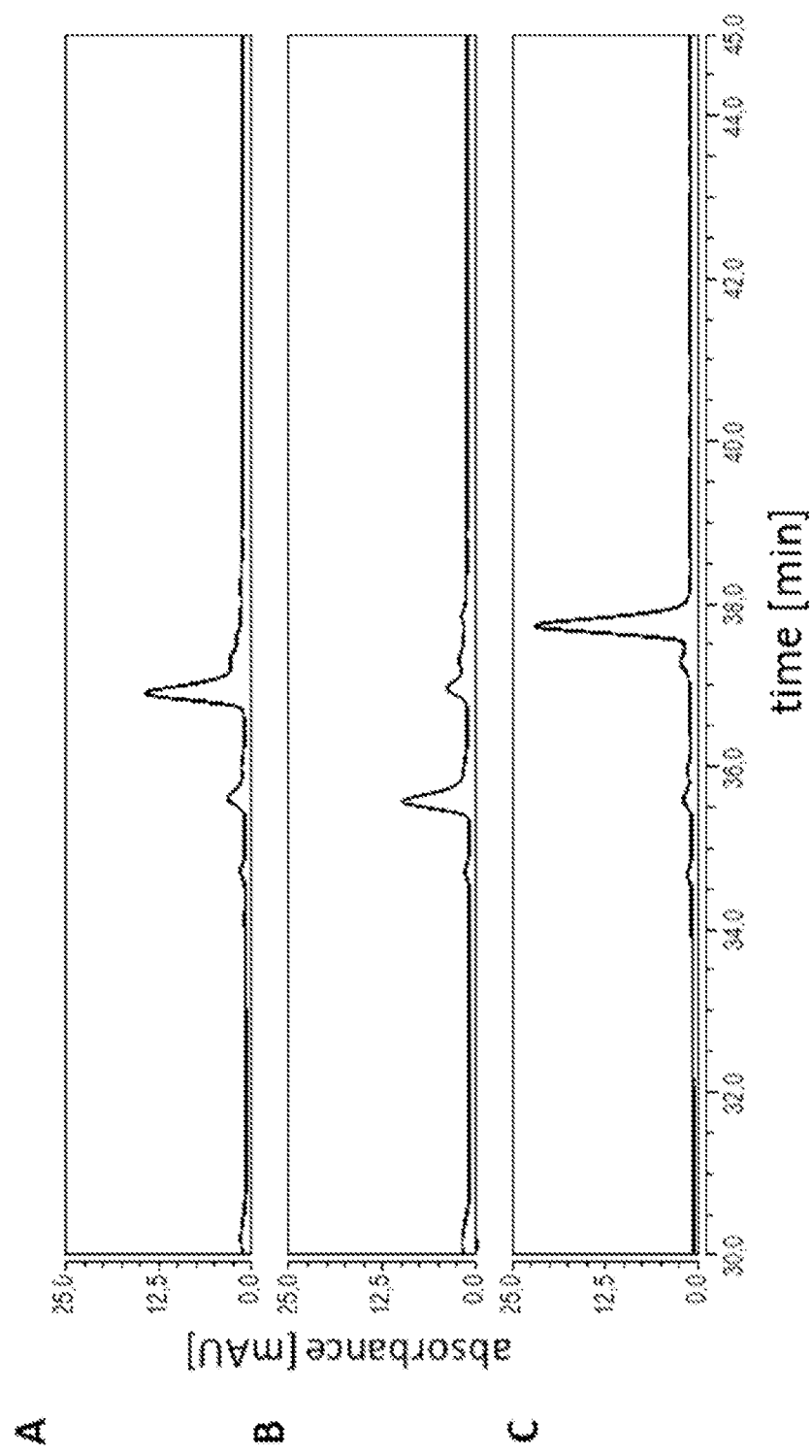

FIG. 16: HPLC analysis of 10mer RNA after capping with re-used VVCE-beads and methylation of capped RNA with re-used MT-beads The figure shows the HPLC analysis of un-capped RNA 10mer (A), the analysis of capped RNA 10mer using VVCE-beads (B), and the analysis of 2'O methylated capped RNA using MT-beads (C). In panel B, the dominant peak represents capped RNA revealing strong enzymatic capping efficiency of the re-used VVCE-beads. The dominant peak in panel C represents capped RNA species with an additional methylation, revealing strong enzymatic methylation efficiency of the re-used MT-beads. A detailed description of the experiment is provided in Example 4.

Figure 17:
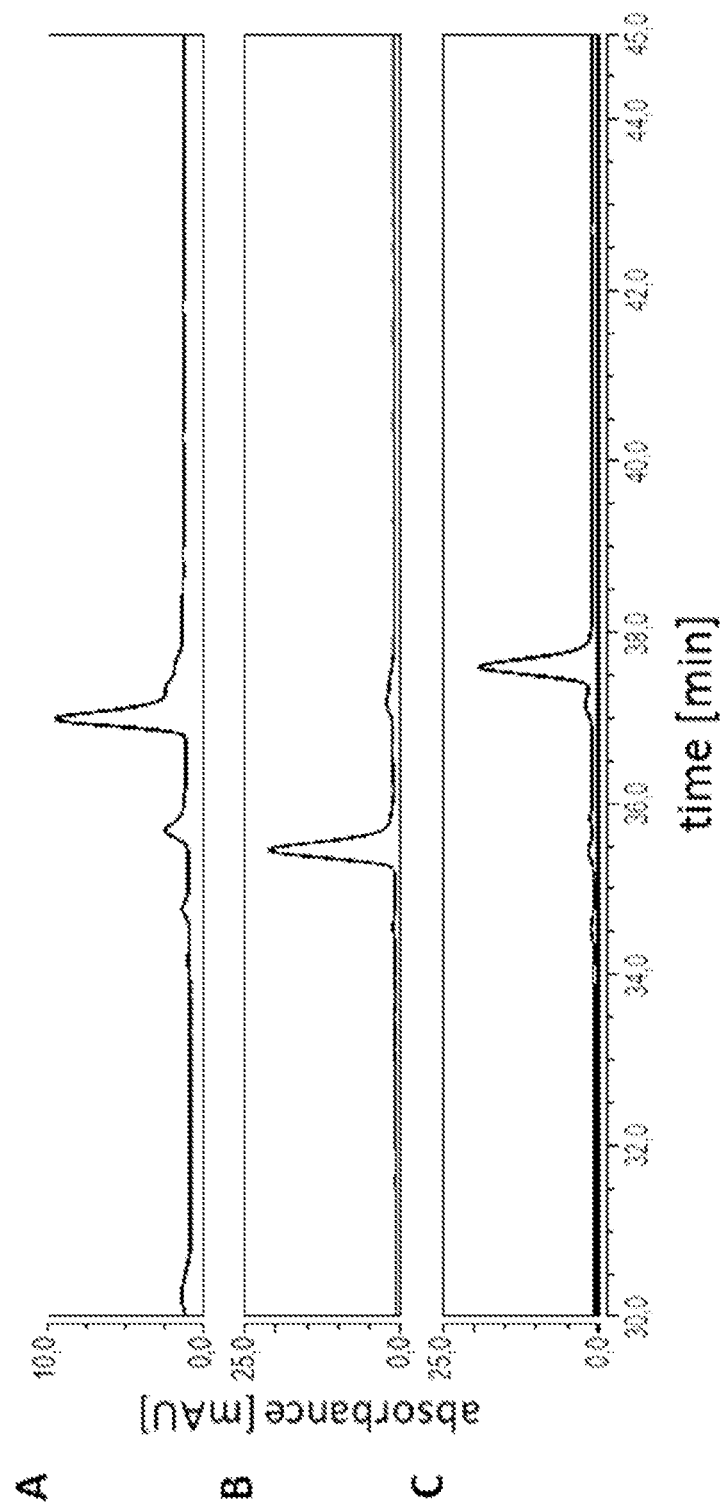

FIG. 17: HPLC analysis of 10mer RNA after capping with stored VVCE-beads and methylation of capped RNA with stored MT-beads The figure shows the HPLC analysis of un-capped RNA 10mer (A), the analysis of capped RNA 10mer using VVCE-beads after long-term storage (B), and the analysis of 2'O methylated capped RNA using MT-beads after long-term storage (C). In panel B, the dominant peak represents capped RNA revealing strong enzymatic capping efficiency of the VVCE-beads after long-term storage. The dominant peak in panel C represents capped RNA species with an additional methylation, revealing strong enzymatic methylation efficiency of the MT-beads after long-term storage. A detailed description of the experiment is provided in Example 5.

Figure 18:
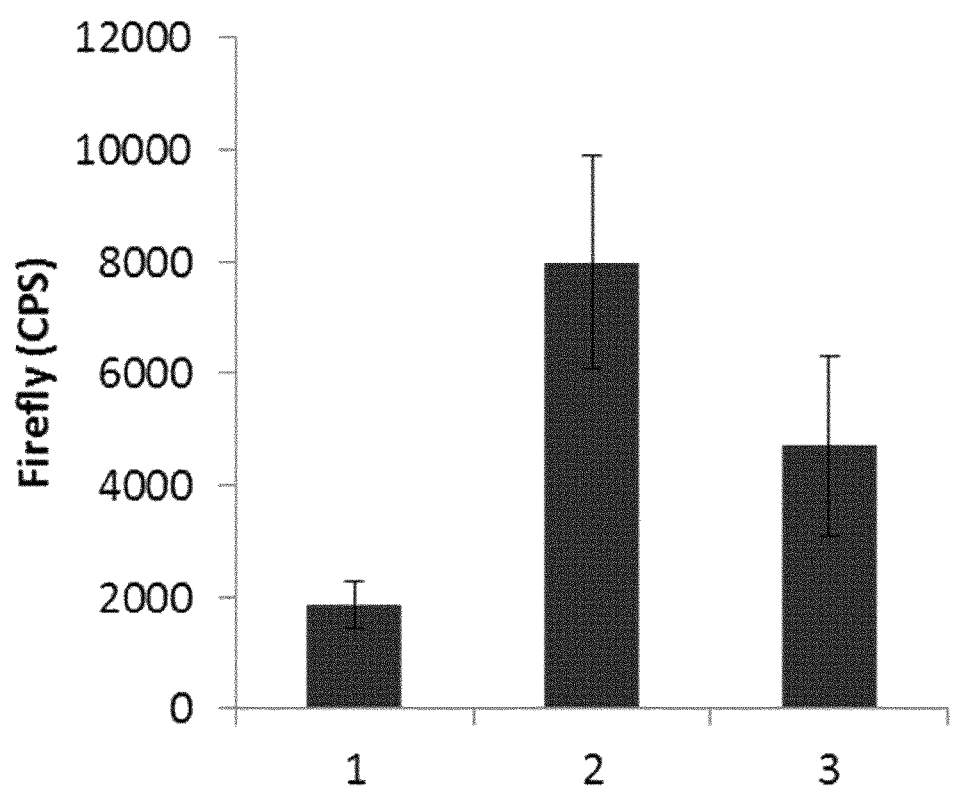

FIG. 18: Functional analysis of capped and 2'O-methylated long mRNA using VVCE-beads and MT-beads Capping as well as 2'O-methylation efficiency of luciferase mRNA using VVCE-beads and MT-beads was monitored by luciferase assays. Untreated luciferase mRNA (uncapped) was used as a control. FIG. 6 shows that capping as well as capping and subsequent 2'O-methylation leads to increased expression of luciferase. 1: untreated luciferase mRNA; 2: capped luciferase mRNA, 3: capped and 2'O-methylated luciferase mRNA. A detailed description of the experiment is provided in Example 6.

Definitions

For the sake of clarity and readability the following definitions are provided. Any technical feature mentioned in these definitions may be read on each and every embodiment of the invention. Additional definitions and explanations may be specifically provided in the context of these embodiments.

Enzyme: Enzymes comprise catalytically active biomolecules that perform biochemical reactions such as DNA-dependent RNA transcription (e.g., RNA polymerases), or double stranded DNA digestion (e.g., restriction endonucleases). Enzymes are typically composed of amino acids and/or RNA (ribozymes, snRNA). Within the context of the present invention, the term enzyme refers to both capping enzyme and cap-specific nucleoside 2' O-methyltransferase, unless specifically indicated.

Recombinant protein: The term 'recombinant protein' refers to proteins that have been produced in a heterologous system, that is, in an organism that naturally does not produce such a protein, or a variant of such a protein. It also refers to a protein which is expressed from a typical expression vector in an expression host which also naturally expresses this protein, but in smaller amounts. Said recombinant protein may also comprise elements necessary for the purification of the protein, e.g. purification tags, such as e.g. oligo histidine tags (HIS-tags). Some other examples of purification tags are depicted in SEQ ID NOs: 40-60. Typically, the heterologous systems used in the art to produce recombinant proteins are bacteria (e.g., *Escherichia coli*), yeast (e.g., *Saccharomyces cerevisiae*) or certain mammalian cell culture lines.

Expression host: An expression host denotes an organism which is used for recombinant protein production, e.g., for the production of recombinant capping enzyme or cap-specific nucleoside 2' O-methyltransferase. General expression hosts are bacteria, such as *E. coli*, yeasts, such as *Saccharomyces cerevisiae* or *Pichia pastoris*, insect cells, or also mammal cells, such as human cells.

Poly(A)polymerase (PAP): Catalyzes the covalent attachment of adenosine to the 3'-end of RNA, in particular mRNA. Other expressions for PAP are (Polynucleotide) adenylyltransferase, poly A polymerase, polyadenylate synthetase, ATP-RNA adenylyltransferase, and polyadenylate polymerase, these terms may be used interchangeably. The poly(A)polymerase of the present invention has preference for ATP and transfers the attachment of adenosine monophosphates to the 3'-end of RNA, particularly mRNA. If at least one adenosine monophosphate is already attached to the RNA, the next adenosine monophosphate is attached thereto, forming a poly(A) sequence. The term "poly(N/A) polymerase" or the abbreviation "PNP/PAP" is used to denote poly(N)polymerase as well as poly(A)polymerase. The same principle applies to poly(N/A)tail or poly(N/A) sequence and others.

Polyadenylation: Polyadenylation is typically understood to be the addition of a poly(A) sequence, i.e. a sequence of adenosine monophosphate, to a nucleic acid molecule, such as an RNA molecule. As used in the context of the present invention, the term may relate to polyadenylation of RNA as a cellular process as well as to polyadenylation carried out by enzymatic reaction in vitro or by chemical synthesis.

Modified nucleoside triphosphate: The term "modified nucleoside triphosphate" as used herein refers to chemical modifications comprising backbone modifications as well as sugar modifications or base modifications. These modified nucleoside triphosphates are also termed herein as (nucleotide) analogs, modified nucleosides/nucleotides or nucleotide/nucleoside modifications.

In this context, the modified nucleoside triphosphates as defined herein are nucleotide analogs/modifications, e.g. backbone modifications, sugar modifications or base modifications. A backbone modification in connection with the present invention is a modification, in which phosphates of the backbone of the nucleotides are chemically modified. A sugar modification in connection with the present invention is a chemical modification of the sugar of the nucleotides. Furthermore, a base modification in connection with the present invention is a chemical modification of the base moiety of the nucleotides. In this context nucleotide analogs or modifications are preferably selected from nucleotide analogs which are applicable for transcription and/or translation. In the context of the present invention, modified nucleotides as defined herein may be used in RNA in vitro transcription reactions, e.g. by adding modified nucleotides as defined herein to the nucleotide mixture which is used in the RNA in vitro transcription process.

Sugar Modifications: The modified nucleosides and nucleotides, which may be used in the context of the present invention, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), -O(CH2CH2o)nCH2CH2OR; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. NH2; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, a modified nucleotide can include nucleotides containing, for instance, arabinose as the sugar.

Backbone Modifications: The phosphate backbone may further be modified in the modified nucleosides and nucleotides. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications: The modified nucleosides and nucleotides, which may be used in the present invention, can further be modified in the nucleobase moiety. Examples of nucleobases found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogs/modifications are selected from base modifications, which are preferably selected from 2-amino-6-chloropurineriboside-5'-triphosphate, 2-Aminopurine-riboside-5'-triphosphate; 2-amino adenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-aza-uridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyl-adenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudo-uridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxy-methyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methyl-guanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'-O-(1-Thiophosphate)-Adenosine, 5'-O-(1-Thiophosphate)-Cytidine, 5'-O-(1-Thiophosphate)-Guanosine, 5'-O-(1-Thiophosphate)-Uridine or 5'-O-(1-Thiophosphate)-Pseudouridine.

In further specific embodiments the modified nucleotides include nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytidine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azidoadenosine, 7-deaza-adenosine.

Further modified nucleotides have been described previously (see, e.g., WO 2013/052523).

5'-cap: A 5'-cap is an entity, typically a modified nucleotide entity, which generally "caps" the 5'-end of a mature mRNA. A 5'-cap may typically be formed by a modified nucleotide (cap analog), particularly by a derivative of a guanine nucleotide. Preferably, the 5'-cap is linked to the 5'-terminus of a nucleic acid molecule, preferably an RNA, via a 5'-5'-triphosphate linkage. A 5'-cap may be methylated, e.g. m7GpppN (e.g. m7G(5')ppp(5')G (m7G)), wherein N is the terminal 5' nucleotide of the nucleic acid carrying the 5'-cap, typically the 5'-end of an RNA. Such a 5'-cap structure is called cap0. In vivo, capping reactions are catalyzed by capping enzymes. In vitro, a 5'-cap may be formed by a modified nucleotide, particularly by a derivative of a guanine nucleotide. Preferably, the 5'-cap is linked to the 5'-terminus via a 5'-5'-triphosphate linkage.

A 5'-cap may be methylated, e.g. m7GpppN, wherein N is the terminal 5' nucleotide of the nucleic acid carrying the 5'-cap, typically the 5'-end of an RNA. m7GpppN is the 5'-cap structure which naturally occurs in mRNA, which is typically referred to as cap0 structure.

Enzymes, such as cap-specific nucleoside 2'-O-methyl-transferase enzyme create a canonical 5'-5'-triphosphate linkage between the 5'-terminal nucleotide of an mRNA and a guanine cap nucleotide wherein the cap guanine contains an N7 methylation and the 5'-terminal nucleotide of the mRNA contains a 2'-O-methyl. Such a structure is called the cap1 structure.

Further examples of 5'cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. Further modified 5'-cap structures which may be used in the context of the present invention are cap1 (additional methylation of the ribose of the adjacent nucleotide of m7GpppN), cap2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse cap analogue), modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

Capping enzyme: A capping enzyme is an enzyme or a complex of enzymes, or an enzyme ensemble that catalyzes the formation of the 5' cap of RNA molecules. Capping occurs by a series of three enzymatic reactions that result in formation of N7-methyl guanosine linked through a 5'-5' inverted triphosphate bridge to the first nucleotide of a transcript. Capping of cellular eukaryotic mRNAs occurs co-transcriptionally and is associated with the RNA polymerase II complex. The enzymatic reaction is catalyzed by the phosphorylated carboxyl-terminal domain (CTD) of RNA polymerase II. Four enzyme activities, i.e. RNA triphosphatase (TPase), guanylyltransferase (GTase), nucleotidyltransferase (NTase) and methyltransferase (MTase), are involved in the addition of the methylated 5' cap to the mRNA. There is diversity in the organization of the capping enzymes in different taxa and in different viruses, ranging from separately encoded TPase, GTase, and MTase enzymes to fusions of two of the capping enzymes within a single polypeptide to fusion of all three enzymes in a single polypeptide. The Vaccinia virus capping enzyme, the first capping enzyme which was purified and characterized, is a heterodimer of D1 ("catalytic polypeptide") and D12 ("regulatory polypeptide") polypeptides. This enzyme is capable of efficiently executing all three steps in m7GpppRNA synthesis, independent of RNA polymerase II. Therefore, the Vaccinia virus capping enzyme has been widely used as in vitro capping reagent and is the preferred capping enzyme of the present invention. Unless stated otherwise, the term "capping enzyme" is intended to comprise the heterodimer of the catalytic polypeptide and the regulatory polypeptide, if this enzyme is naturally occurring as a heterodimer.

Catalytic polypeptide: The term "catalytic polypeptide" refers to the part of a heterodimeric capping enzyme that executes all steps in m7GpppRNA synthesis. A particular example of a "catalytic polypeptide" in the context of the present invention is the D1 polypeptide of a D1-D12 heterodimeric capping enzyme (e.g., a capping enzyme of the Vaccinia virus). The enzymatic activities (TPase, GTase, NTase, MTase) of the VV capping enzyme are located on the large D1 polypeptide chain (catalytic polypeptide). Examples of catalytic polypeptides or D1 polypeptides in the context of the invention comprise polypeptides having the amino acid sequence according to any one of SEQ ID NOs: 1, 61-97 and functional fragments, derivatives and variants thereof.

Regulatory polypeptide: The term "regulatory polypeptide" refers to the part of a heterodimeric capping enzyme that has no enzymatic activity on its own, but stimulates and/or regulates the enzymatic activity of a heterodimeric partner such as the catalytic polypeptide. A particular example of a "regulatory polypeptide" in the context of the present invention is the D12 polypeptide of the D1-D12 heterodimeric capping enzyme (e.g., a capping enzyme of the Vaccinia virus). The D12 polypeptide chain allosterically stimulates the methyltransferase (MTase) activity located on the large catalytic polypeptide D1. Examples of regulatory polypeptides or D12 polypeptides in the context of the invention comprise polypeptides with the amino acid sequence according to any one of SEQ ID NOs: 2 and 98-127 or functional fragments, derivatives and variants thereof.

Cap0 structure: A typical cap0 structure is m7GpppN, wherein N is the terminal 5' nucleotide of the nucleic acid carrying the 5'-cap, typically the 5'-most nucleotide of an RNA, m7G is a guanine which is methylated at position 7 and ppp are three phosphates.

Cap-specific nucleoside 2'-O-methyltransferase: Cap-specific nucleoside 2'-O-methyltransferase enzyme can create a canonical 5'-5'-triphosphate linkage between the 5'-terminal nucleotide of an mRNA and a guanine cap nucleotide wherein the cap guanine contains an N7 methylation and the 5'-terminal nucleotide of the mRNA contains a 2'-O-methyl group. Such a structure is called the cap1 structure. This cap results in a higher translational competency and cellular stability and a reduced activation of cellular pro-inflammatory cytokines, as compared, e.g., to other 5' cap analog structures known in the art. Examples of cap-specific nucleoside 2'-O-methyltransferase enzyme in the context of the invention comprise polypeptides with the amino acid sequence according to any one of SEQ ID NOs: 3 and 128-160 or functional fragments, derivatives and variants thereof.

Cap1 structure: A cap1 structure has a 2'-O-methyl at the 5'-terminal nucleotide of the RNA in addition to the cap0 structure.

Capping degree: The term "capping degree" refers to the number of RNA molecules having a cap0 structure compared to the total number of RNA molecules within a sample. If the RNA molecules are additionally treated with a cap-specific nucleoside 2'-O-methyltransferase, the term "capping degree" also refers to the number of RNA molecules having a cap1 structure compared to the total number of RNA molecules within the sample or to the number of RNA molecules having a cap0 structure. The capping degree may be determined by HPLC analysis as described in the examples. Preferably, an ion-pair, reversed-phase chromatography is performed. In particular, a HPLC column such as a ACQUITY UPLC® Oligonucleotide BEH C18 Column, 130 Å, 1.7 µm, 2.1 mm×50 mm may be loaded with an RNA sample in 0.1% TEAA and the RNA may be eluted with 0.1% TEAA and 25% acetonitrile. As can be seen in the figures, a first peak representing the capped RNA and a second peak representing the uncapped RNA can be distinguished. By calculating the ratio of the first peak to the sum of the first and the second peak, the capping degree can be calculated.

Protein: A protein typically comprises one or more peptides or polypeptides. A protein is typically folded into 3-dimensional form, which may be required for the protein to exert its biological function. The sequence of a protein or peptide is typically understood to be the order, i.e. the succession of its amino acids.

Functional fragment: A functional fragment of a protein, in particular the catalytic polypeptide, the regulatory polypeptide or the cap-specific nucleoside 2'-O-methyltransferase, is a part of said protein having the same succession of amino acids as the corresponding part in the wild-type protein, but having a lower number of amino acids than the wild-type protein, since it lacks one or more amino acids on the N- and/or the C-terminus of the protein. The fragment of the protein, in particular the catalytic polypeptide, the regulatory polypeptide or the cap-specific nucleoside 2'-O-methyltransferase, is functional, if it retains substantially the same activity as the wild-type protein.

Poly(A) sequence: A poly(A) sequence, also called poly (A) tail or 3'-poly(A) tail, is typically understood to be a sequence of adenine nucleotides, e.g., of up to about 400 adenine nucleotides, e.g. from about 20 to about 400, preferably from about 50 to about 400, more preferably from about 50 to about 300, even more preferably from about 50 to about 250, most preferably from about 60 to about 250 adenine nucleotides. A poly(A) sequence is typically located at the 3' end of an mRNA. In the context of the present invention, a poly(A) sequence may be located within an mRNA or any other nucleic acid molecule, such as, e.g., in a vector, for example, in a vector serving as template for the generation of an RNA, preferably an mRNA, e.g., by transcription of the vector. Additionally, a poly(A)sequence may be generated enzymatically using a poly(A)polymerase.

RNA, mRNA: RNA is the usual abbreviation for ribonucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers or analogs thereof (so-called modified nucleotides), which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. In vivo, transcription of DNA usually results in the so-called premature RNA which has to be processed into so-called messenger-RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino acid sequence of a particular peptide or protein. Typically, a mature mRNA comprises a 5'-cap, optionally a 5'UTR, an open reading frame, optionally a 3'UTR and a poly(A) sequence. Aside from messenger RNA, several non-coding types of RNA exist which may be involved in regulation of transcription and/or translation. The term "RNA" further encompass other coding RNA molecules, such as viral RNA, retroviral RNA and replicon RNA. In addition to messenger RNA, several non-coding types of RNA exist which may be involved in regulation of transcription and/or translation, and immunostimulation. The term "RNA" further encompasses RNA molecules, such as viral RNA, retroviral RNA and replicon RNA, small interfering RNA (siRNA), antisense RNA, CRISPR/cas9 guide RNA, ribozymes, aptamers, riboswitches, immunostimulating RNA (isRNA), transfer RNA (tRNA), ribosomal RNA (rRNA), small nuclear RNA (snRNA), small nucleolar RNA (snoRNA), microRNA (miRNA), and Piwi-interacting RNA (piRNA). Short RNA molecules can be synthesized by chemical methods whereas long RNAs are typically produced by in vitro transcription reactions containing a suitable DNA template with a bacteriophage-derived promoter, an RNA polymerase, for example bacteriophage SP6, T3 or T7 RNA polymerase and ribonucleoside triphosphates (NTPs).

In vitro transcribed RNA: An in vitro transcribed RNA is an RNA molecule that has been synthesized from a DNA template, commonly a linearized and purified plasmid DNA template, a PCR product, or an oligonucleotide by RNA in vitro transcription. RNA synthesis occurs in a cell-free ("in vitro") system catalyzed by DNA-dependent RNA polymerases. Particular examples of DNA dependent RNA polymerases are the T7, T3, and SP6 RNA polymerases. An in vitro transcribed RNA may comprise elements such as 5'-cap, optionally a 5'UTR, an open reading frame, optionally a 3'UTR and a poly(A) sequence. Aside from messenger RNA, several non-coding types of RNA exist which may be involved in regulation of transcription and/or translation. Such RNA molecules may also be synthetized by RNA in vitro transcription.

DNA: DNA is the usual abbreviation for deoxy-ribonucleic-acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are—by themselves—composed of a sugar moiety (deoxyribose), a base moiety and a phosphate moiety, and polymerize by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA sequence. DNA may be single-stranded or double-stranded. In the double stranded form, the nucleotides of the first strand typically hybridize with the nucleotides of the second strand, e.g. by A/T-base-pairing and G/C-base-pairing.

Sequence identity: Two or more sequences are identical, if they exhibit the same length and order of nucleotides or amino acids. The percentage of identity typically describes the extent to which two sequences are identical, i.e. it typically describes the percentage of nucleotides that correspond in their sequence position to identical nucleotides of a reference sequence. For the determination of the degree of identity, the sequences to be compared are considered to exhibit the same length, i.e. the length of the longest sequence of the sequences to be compared. This means that a first sequence consisting of 8 nucleotides/amino acids is 80% identical to a second sequence consisting of 10 nucleotides/amino acids comprising the first sequence. In other words, in the context of the present invention, identity of sequences preferably relates to the percentage of nucleotides/amino acids of a sequence, which have the same position in two or more sequences having the same length. Gaps are usually regarded as non-identical positions, irrespective of their actual position in an alignment. Typically, alignment is performed using a suitable alignment software such as BLAST or ClustalW.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising an open reading frame. Such vectors may be storage vectors, expression vectors, cloning vectors, transfer vectors etc. A storage vector is a vector, which allows the convenient storage of a nucleic acid molecule, for example, of an mRNA molecule. Thus, the vector may comprise a sequence corresponding, e.g., to a desired mRNA sequence or a part thereof, such as a sequence corresponding to the open reading frame and the 3'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector, which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

3'-untranslated region (3'-UTR): Generally, the term "3'-UTR" refers to a part of the artificial nucleic acid molecule, which is located 3' (i.e. "downstream") of an open reading frame and which is not translated into protein. Typically, a 3'-UTR is the part of an mRNA, which is located between the protein coding region (open reading frame (ORF) or coding sequence (CDS)) and the poly(N/A) sequence of the (m)RNA. In the context of the invention, a 3'-UTR of the artificial nucleic acid molecule may comprise more than one 3'-UTR elements, which may be of different origin, such as sequence elements derived from the 3'-UTR of several (unrelated) naturally occurring genes. Accordingly, the term 3'-UTR may also comprise elements, which are not encoded in the template, from which an RNA is transcribed, but which are added after transcription during maturation, e.g. a poly(N/A) sequence. A 3'-UTR of the mRNA is not translated into an amino acid sequence. The 3'-UTR sequence is generally encoded by the gene, which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5' capping, splicing the pre-mature mRNA to excize optional introns and modifications of the 3'-end, such as polynucleotidylation/polyadenylation of the 3'-end of the pre-mature mRNA and optional endo-/ or exonuclease cleavages etc. In the context of the present invention, a 3'-UTR corresponds to the sequence of a mature mRNA which is located between the stop codon of the protein coding region, preferably immediately 3' to the stop codon of the protein coding region, and the poly(N/A) sequence of the mRNA. The term "corresponds to" means that the 3'-UTR sequence may be an RNA sequence, such as in the mRNA sequence used for defining the 3'-UTR sequence, or a DNA sequence, which corresponds to such RNA sequence. In the context of the present invention, the term "a 3'-UTR of a gene", such as "a 3'-UTR of a ribosomal protein gene", is the sequence, which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR. As used herein, the term "3'-UTR element" typically refers to a fragment of a 3'-UTR as defined herein. In particular, the term comprises any nucleic acid sequence element, which is located 3' to the ORF in the artificial nucleic acid molecule, preferably the mRNA, according to the invention. Accordingly, the term covers, for example, sequence elements derived from the 3'-UTR of a heterologous gene as well as elements such as a poly(C) sequence or a histone stem-loop.

5'-untranslated region (5'-UTR): A 5'-UTR is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, which are also called regulatory elements. Such regulatory elements may be, for example, ribosomal binding sites. The 5'-UTR may be posttranscriptionally modified, for example by addition of a 5'-cap. In the context of the present invention, a 5'-UTR corresponds to the sequence of a mature mRNA, which is located between the 5'-cap and the start codon. Preferably, the 5'-UTR corresponds to the sequence, which extends from a nucleotide located 3' to the 5'-cap, preferably from the nucleotide located immediately 3' to the 5'-cap, to a nucleotide located 5' to the start codon of the protein coding region, preferably to the nucleotide located immediately 5' to the start codon of the protein coding region. The nucleotide located immediately 3' to the 5'-cap of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence, which corresponds to such RNA sequence. In the context of the present invention, the term "a 5'-UTR of a gene" is the sequence, which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence of the 5'-UTR.

Cloning site: A cloning site is typically understood to be a segment of a nucleic acid molecule, which is suitable for insertion of a nucleic acid sequence, e.g., a nucleic acid sequence comprising an open reading frame. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Open reading frame: An open reading frame (ORF) in the context of the invention may typically be a sequence of several nucleotide triplets which may be translated into a peptide or protein. An open reading frame preferably contains a start codon, i.e. a combination of three subsequent nucleotides coding usually for the amino acid methionine (ATG), at its 5'-end and a subsequent region which usually exhibits a length which is a multiple of 3 nucleotides. An ORF is preferably terminated by a stop-codon (e.g., TAA, TAG, TGA). Typically, this is the only stop-codon of the open reading frame. Thus, an open reading frame in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The open reading frame may be isolated or it may be incorporated in a longer nucleic acid sequence, for example in a vector or an mRNA. An open reading frame may also be termed "protein coding region" or "coding sequence (cds)".

RNA in vitro transcription: The term "in vitro transcription" or "RNA in vitro transcription" relates to a process wherein RNA, in particular mRNA, is synthesized in a cell-free system (in vitro). Preferably, cloning vectors, particularly plasmid DNA vectors are applied for the generation of transcripts. These cloning vectors are generally designated as transcription vector. RNA may be obtained by DNA dependent in vitro transcription of an appropriate DNA template, which according to the present invention is a linearized plasmid DNA template. The promoter for controlling RNA in vitro transcription can be any promoter for any DNA dependent RNA polymerase. Particular examples of DNA dependent RNA polymerases are the T7, T3, and SP6 RNA polymerases. A DNA template for RNA in vitro transcription may be obtained by cloning of a nucleic acid, in particular cDNA corresponding to the respective RNA to be in vitro transcribed, and introducing it into an appropriate vector for RNA in vitro transcription, for example in plasmid DNA. The cDNA may be obtained by reverse transcription of mRNA. Moreover, the DNA template for in vitro RNA synthesis may also be obtained by gene synthesis. Preferably cloning vectors are used for RNA in vitro transcription, which are generally designated transcription vectors.

Methods for in vitro transcription are known in the art (Geall et al. (2013) Semin. Immunol. 25(2): 152-159; Brunelle et al. (2013) Methods Enzymol. 530:101-14). Reagents used in said method typically include:
1) a linearized DNA template (as defined above) with a promoter sequence that has a high binding affinity for its respective RNA polymerase such as bacteriophage-encoded RNA polymerases;
2) ribonucleoside triphosphates (NTPs) for the four bases (adenine, cytosine, guanine and uracil), and optionally one or more modified nucleotides as defined above;
3) optionally a cap analog as defined above (e.g. m7G(5') ppp(5')G (m7G));
4) a DNA-dependent RNA polymerase capable of binding to the promoter sequence within the linearized DNA template (e.g. T7, T3 or SP6 RNA polymerase);
5) optionally a ribonuclease (RNase) inhibitor to inactivate any contaminating RNase;
6) optionally a pyrophosphatase to degrade pyrophosphate, which may inhibit transcription;
7) $MgCl_2$, which supplies $Mg^{2+}$ ions as a co-factor for the polymerase;
8) a buffer to maintain a suitable pH value, which can also contain antioxidants (e.g. DTT) and polyamines such as spermidine at optimal concentrations.

According to a preferred embodiment, the (transcription) buffer is selected from the group consisting of 4-(2-hydroxyethyl)-1-piperazineethanesulfonic acid (HEPES) and tris (hydroxymethyl)aminomethane (Tris). Preferably, the buffer is used at a concentration from 10 to 100 mM, 10 to 75 mM, 10 to 50 mM, 10 to 40 mM, 10 to 30 mM or 10 to 20 mM. The pH value of the buffer can be adjusted with, for example, NaOH, KOH or HCl. Preferably, the buffer has a pH value from 6 to 8.5, from 6.5 to 8.0, from 7.0 to 7.5, even more preferred 7.5. Most preferred is a buffer selected from the group consisting of 80 mM HEPES/KOH, pH 7.5 and 40 mM Tris/HCl, pH 7.5.

According to a preferred embodiment of the invention, the RNA polymerase is selected from the group consisting of T3, T7 and SP6 RNA polymerase. Preferably, the concentration of the RNA polymerase is from about 1 to 100 nM, 1 to 90 nM, 1 to 80 nM, 1 to 70 nM, 1 to 60 nM, 1 to 50 nM, 1 to 40 nM, 1 to 30 nM, 1 to 20 nM, or about 1 to 10 nM. Even more preferred, the concentration of the RNA polymerase is from about 10 to 50 nM, 20 to 50 nM, or 30 to 50 nM. Most preferred is a RNA polymerase concentration of about 40 nM. The person skilled in the art will understand that the choice of the RNA polymerase concentration is influenced by the concentration of the DNA template. Therefore, in specific embodiments the concentration of the RNA polymerase is between 1 and 1000 U/μg template DNA, preferably between 10 and 100 U/μg DNA, particularly if plasmid DNA is used as template DNA.

According to a preferred embodiment of the invention, the concentration of the linear DNA template is in a range from about 1 to 50 nM, 1 to 40 nM, 1 to 30 nM, 1 to 20 nM, or about 1 to 10 nM. Even more preferred the concentration of the DNA template is from about 10 to 30 nM. Most preferred the concentration of the DNA template is about 20 nM. In case plasmid DNA is used as DNA template, the concentration of the DNA template is preferably between 1 to 100 µg/ml, particularly in a concentration of about 50 µg/ml.

According to a preferred embodiment of the invention, the RNA in vitro transcription reaction is performed in the presence of pyrophosphatase. Preferably, the concentration of the pyrophosphatase is from about 1 to 20 units/ml, 1 to 15 units/ml, 1 to 10 units/ml, 1 to 5 units/ml, or 1 to 2.5 units/ml. Even more preferred the concentration of the pyrophosphatase is about 5 unit/ml.

According to a preferred embodiment of the invention, the RNA in vitro transcription reaction mixture comprises $Mg^{2+}$ ions. Preferably, the $Mg^{2+}$ ions are provided in the form of $MgCl_2$ or $Mg(OAc)_2$. Preferably, the initial free $Mg^{2+}$ concentration is from about 1 to 100 mM, 1 to 75 mM, 1 to 50 mM, 1 to 25 mM, or 1 to 10 mM. Even more preferred the initial free $Mg^{2+}$ concentration is from about 10 to 30 mM or about 15 to 25 mM. Most preferred is an initial free $Mg^{2+}$ concentration of about 24 mM. The person skilled in the art will understand that the choice of the $Mg^{2+}$ concentration is influenced by the initial total NTP concentration.

According to a preferred embodiment of the invention, the RNA in vitro transcription reaction mixture comprises a reducing agent (antioxidant) to keep the RNA polymerase in its active state. Preferably, the reducing agent is selected from the group consisting of dithiothreitol (DTT), dithioerythritol (DTE), Tris(2-carboxyethyl)phosphine (TCEP) and β-mercaptoethanol. Preferably the concentration of the reducing reagent is from about 1 to 50 mM, 1 to 40 mM, 1 to 30 mM, or 1 to 20 mM, or 1 to 10 mM. Even more preferred the concentration of the reducing reagent is from 10 to 50 mM or 20 to 40 mM. Most preferred is a concentration of 40 mM of DTT.

According to a preferred embodiment of the invention, the RNA in vitro transcription reaction mixture comprises a polyamine. Preferably, the polyamine is selected from the group consisting of spermine and spermidine. Preferably the concentration of the polyamine is from about 1 to 25 mM, 1 to 20 mM, 1 to 15 mM, 1 to 10 mM, 1 to 5 mM, or about 1 to 2.5 mM. Even more preferred the concentration of the polyamine is about 2 mM. Most preferred is a concentration of 2 mM of spermidine.

According to a preferred embodiment of the invention, the RNA in vitro transcription reaction mixture comprises a ribonuclease inhibitor. Preferably, the concentration of the ribonuclease inhibitor is from about 1 to 500 units/ml, 1 to 400 units/ml, 1 to 300 units/ml, 1 to 200 units/ml, or 1 to 100 units/ml. Even more preferred the concentration of the ribonuclease inhibitor is about 200 units/ml.

According to a preferred embodiment of the invention, the total NTP concentration in the RNA in vitro transcription reaction mixture is between 1 and 100 mM, preferably between 10 and 50 mM, and most preferably between 10 and 20 mM.

According to the invention, the term total nucleotide concentration means the total concentration of NTPs, e.g. the sum of the concentrations of ATP, GTP, CTP, UTP or modified nucleotides, and/or cap analog present initially in the in vitro transcription when the various components of the reaction have been assembled in the final volume for carrying out the in vitro transcription reaction. Naturally, as the reaction proceeds, the nucleotides will be incorporated into the RNA molecule and consequently the total nucleotide concentration will be progressively reduced from its initial value.

In this context it is particularly preferred that the single nucleotides are provided in a concentration between 0.1 and 10 mM, preferably between 1 and 5 mM and most preferably in a concentration of 4 mM.

The ribonucleoside triphosphates (NTPs) GTP, ATP, CTP and UTP or analogs thereof may be provided with a monovalent or divalent cation as counterion.

Preferably the monovalent cation is selected from the group consisting of $Li^+$, $Na^+$, $K^+$, $NH4^+$ or tris(hydroxymethyl)-aminomethane (Tris). Preferably, the divalent cation is selected from the group consisting of $Me^+$, $Ba^{2+}$ and $Mn^{2+}$.

According to a preferred embodiment of the invention, a part or all of at least one ribonucleoside triphosphate in the in vitro transcription reaction mixture is replaced with a modified nucleoside triphosphate (as defined herein). In a preferred embodiment of the invention, said modified nucleoside triphosphate is selected from the group consisting of pseudouridine-5'-triphosphate, 1-methylpseudouridine-5'-triphosphate, 2-thiouridine-5'-triphosphate, 4-thiouridine-5'-triphosphate and 5-methylcytidine-5'-triphosphate.

After RNA in vitro transcription has occurred, the RNA product is subjected to purification methods. In this context any purification method may be used (e.g. DNA template digest, phenol-chloroform extraction, LiCl precipitation, HPLC, etc.).

Enzyme reactor: An "enzyme reactor", also called "capping reactor", may be any enzyme reactor comprising a vessel suitable for comprising the capping enzyme and/or the cap-specific nucleoside 2'-O-methyltransferase of the present invention which is immobilized onto a solid support. The enzyme reactor is further suitable for comprising the other components of the capping reaction, such as nucleotides, in particular guanosine triphosphate (GTP), a methyl donor, in particular S-adenosylmethionine, and RNA molecules, as well as water, buffer components and salts and is suitable for performing the cap0 and/or the cap1 reaction. That means the enzyme reactor is suitable so that the operator can apply the desired reaction conditions, e.g., temperature, reaction component concentration, salt and buffer concentration, pressure and pH value. The enzyme reactor further allows for the introduction and removal of the reaction components.

Reaction components: "Reaction components" or "components of the capping reaction" denote the components of the capping reaction, i.e. immobilized capping enzyme and/or the cap-specific nucleoside 2'-O-methyltransferase, nucleotides, a methyl donor, and RNA. Additional components are water, buffer components and salts.

Newly introduced amino acids: "Newly introduced amino acids" denote amino acids which are newly introduced into an amino acid sequence in comparison to a native amino acid sequence, usually by mutagenesis. The native amino acid sequence is changed in order to have a certain amino acid side chain at a desired position within the amino acid sequence. In the present invention, in particular the amino acid cysteine is newly introduced into the amino acid sequence at one or more desired positions since the side chain of cysteine being a thiol group allows for easy and straightforward immobilization of the capping enzyme or the cap-specific nucleoside 2'-O-methyltransferase onto a solid support via formation of a disulfide bridge or thioether bond, depending on the functional group of the solid support.

Functional group: The term is to be understood according to the skilled person's general understanding in the art and denotes a chemical moiety which is present on a molecule, in particular on the solid support, and which may participate in a covalent or non-covalent bond to another chemical molecule, such as of a capping enzyme or a cap-specific nucleoside 2'-O-methyltransferase.

Native amino acid sequence: The term, which is equivalent to the term "wild-type sequence", is to be understood according to the skilled person's general understanding in the art and denotes the amino acid sequence in the form of its occurrence in nature without any mutation or amino acid amendment by man. "Native capping enzyme" refers to a capping enzyme having the amino acid sequence as it occurs in nature. "Native cap-specific nucleoside 2'-O-methyltransferase" refers to a cap-specific nucleoside 2'-O-methyltransferase having the amino acid sequence as it occurs in nature. The presence or absence of an N-terminal methionine, which depends on the expression host used, usually does not change the status of a protein being considered as having its natural or native sequence.

Mutated: The term is to be understood according to the skilled person's general understanding in the art. An amino acid sequence is called "mutated", if it contains at least one additional, deleted or exchanged amino acid in its amino acid sequence in comparison to its natural or native amino acid sequence, i.e. if it contains an amino acid mutation. Mutated proteins are also called mutants. "Mutated to comprise only one cysteine residue" means that the amino acid sequence has been changed on the amino acid level so that the amino acid sequence contains only one cysteine residue. This may include that a cysteine residue was introduced via site-directed mutagenesis or that one or more cysteine residues were removed, leaving only one cysteine residue in the amino acid sequence.

Immunostimulatory RNA: An immunostimulatory RNA (isRNA) in the context of the invention may typically be a RNA that is able to induce an innate immune response. An isRNA usually does not have an open reading frame and thus does not provide a peptide-antigen, but elicits an innate immune response, e.g. by binding to pathogen-associated molecular patterns (PAMP) receptors (e.g. Toll-like-receptor (TLR) or other intracellular RNA sensors (e.g. RIG-I, MDA-5 or PKR).

Gene therapy: Gene therapy may typically be understood to mean a treatment of a patient's body or isolated elements of a patient's body, for example isolated tissues/cells, by nucleic acids encoding of a peptide or protein. It may typically comprise at least one of the steps of a) administration of a nucleic acid, preferably an artificial nucleic acid molecule as defined herein, directly to the patient—by whatever administration route—or in vitro to isolated cells/tissues of the patient, which results in transfection of the patient's cells either in vivo/ex vivo or in vitro; b) transcription and/or translation of the introduced nucleic acid molecule; and optionally c) re-administration of isolated, transfected cells to the patient, if the nucleic acid has not been administered directly to the patient.

(Genetic) vaccination: "Genetic vaccination" or "vaccination" may typically be understood to be vaccination by administration of a nucleic acid molecule encoding an antigen or an immunogen or fragments thereof. The nucleic acid molecule may be administered to a subject's body or to isolated cells of a subject. Upon transfection of certain cells of the body or upon transfection of the isolated cells, the antigen or immunogen may be expressed by those cells and subsequently presented to the immune system, eliciting an adaptive, i.e. antigen-specific immune response. Accordingly, genetic vaccination typically comprises at least one of the steps of a) administration of a nucleic acid, preferably an artificial nucleic acid molecule as defined herein, to a subject, preferably a patient, or to isolated cells of a subject, preferably a patient, which usually results in transfection of the subject's cells, either in vivo or in vitro; b) transcription and/or translation of the introduced nucleic acid molecule; and optionally c) re-administration of isolated, transfected cells to the subject, preferably the patient, if the nucleic acid has not been administered directly to the patient.

Immunotherapy: The term "immunotherapy" is to be understood according to the general understanding of the skilled person in the fields of medicine and therapy. Also used in this context are the terms "biologic therapy" or "biotherapy". It is the treatment of a disease by inducing, enhancing, or suppressing an immune response in a patient's body and comprises in particular cancer immunotherapy. Immunotherapy is also being applied in many other disease areas, including allergy, rheumatoid disease, autoimmunity and transplantation, as well as in many infections, such as HIV/AIDS and hepatitis.

Protein replacement therapy: The term "protein replacement therapy" is to be understood according to the general understanding of the skilled person in the fields of medicine and therapy and denotes, in its broadest sense, that a protein which is absent in a patient or not available in the necessary amount is provided to the patient or "replaced". In general, this is done by administering to the patient an intravenous infusion containing the enzyme. Enzyme replacement therapy is e.g. available for lysosomal diseases, such as Gaucher disease, Fabry disease, MPS I, MPS II (Hunter syndrome), MPS VI and Glycogen storage disease type II. Enzyme replacement therapy does not affect the underlying genetic defect, but increases the concentration of the deficient enzyme.

Pharmaceutically effective amount: A pharmaceutically effective amount in the context of the invention is typically understood to be an amount that is sufficient to induce a pharmaceutical effect, such as an immune response, altering a pathological level of an expressed peptide or protein, or substituting a lacking gene product, e.g., in case of a pathological situation.

Immobilization: The term immobilization relates to the attachment of a molecule such as a protein and preferably a capping enzyme and/or a cap-specific 2'-O-methyltransferase to an inert, insoluble material which is also called solid support.

Linker: A linker is typically a short amino acid sequence which links two domains or amino acids, but does not have a biological function itself. Linkers which can be used in the invention may comprise between 1 and 20 amino acids, preferably between 3 and 18 amino acids, more preferably between 5 and 15 amino acids and most preferably between 8 and 12 amino acids. The linker molecule typically consists of small amino acid residues such as glycine and serine. Examples of suitable linkers according to the present invention are depicted in SEQ ID NOs: 15-39 and SEQ ID NOs: 361-385.

DETAILED DESCRIPTION OF THE INVENTION

To solve the above mentioned problem, the present invention uses immobilized capping enzymes for the synthesis of a 5' cap0 structure of uncapped RNA, preferably in vitro transcribed RNA (as defined above), and immobilized cap-specific nucleoside 2'-O-methyltransferase for the synthesis of a cap1 structure generated from 5' cap0 RNA.

In a first aspect, the present invention discloses an immobilized capping enzyme, which generates 5' cap0 structures of uncapped RNA, preferably in the production process of in vitro transcribed RNA.

In a second aspect, the present invention discloses immobilized cap-specific nucleoside 2' O-methyltransferases for enzymatically converting a 5' cap0 structure of RNA into a 5' cap1 structure, preferably in the production process of in vitro transcribed RNA.

In this context, any known capping enzyme or 2'-O-methyltransferase of eukaryotes or eukaryotic viruses may be used.

For immobilization of said enzymes, any coupling or attachment strategy may be used. Preferably, the immobilization is via covalent binding, affinity binding, physical adsorption, encapsulation or entrapment. More preferably, the immobilization is via covalent binding between the capping enzyme or the cap-specific nucleoside 2' O-methyltransferase and the solid support.

In general, it is known in the art that immobilization of enzymes could avoid steric hindrances, enzyme aggregation and denaturation (Mateo, Cesar, et al. "Improvement of enzyme activity, stability and selectivity via immobilization techniques." *Enzyme and Microbial Technology* 40.6 (2007): 1451-1463.). Hence, it is beneficial to immobilize the capping enzyme or the cap-specific nucleoside 2' O-methyltransferase via an amino acid which is located on the surface of the protein when correctly folded into its 3-dimensional form and is not within the active center of the enzyme, i.e. not catalytically involved in any of the RNA triphosphatase, guanylyltransferase and methyltransferase activities of the capping enzyme or the methyltransferase activity of the cap-specific nucleoside 2' O-methyltransferase. This aspect is important so that the enzyme retains its biological activity although immobilized onto a solid support.

Principally, immobilization of an enzyme can be performed in manifold ways, as exemplified in various reviews, including (Datta, Sumitra, L. Rene Christena, and Yamuna Rani Sriramulu Rajaram. 3 Biotech 3.1 (2013): 1-9; Kim, Dohyun, and Amy E. Herr. Biomicrofluidics 7.4 (2013): 041501).

Figure 1:
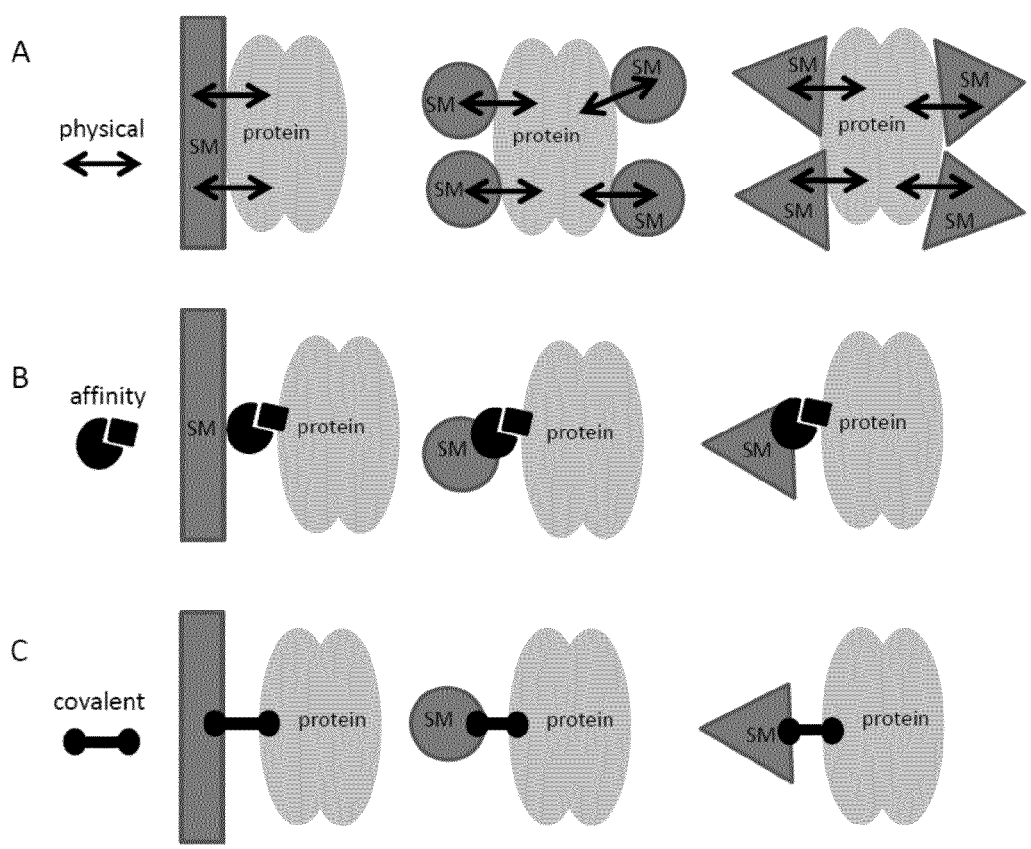
FIG. 1 Representative immobilization procedures for a capping enzyme

An immobilization procedure for a capping enzyme and cap-specific nucleoside 2'-O-methyltransferase has to consider aspects of how the enzyme may be coupled and on which support material the coupling may occur. Immobilization of respective enzymes comprises two technical aspects: support material and coupling/attachment of the enzymes to the support material (FIG. 1).

Figure 2:
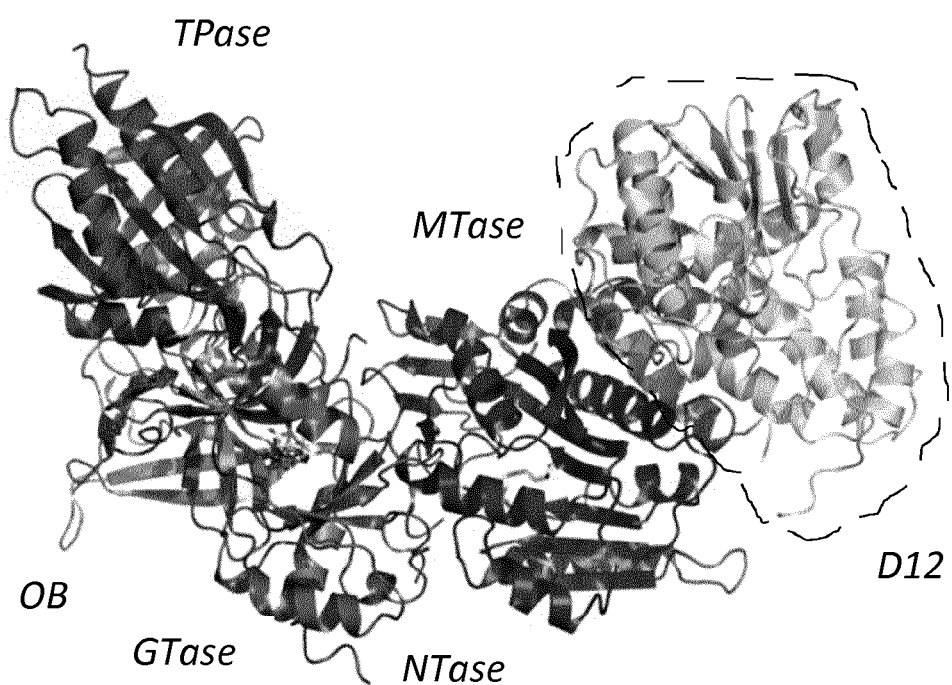

Capping enzymes have, besides other important structural features, TPase domains, GTase domains, MTase domains, dimerization or multimerization domains, binding pockets for substrates, and RNA binding grooves or surfaces (FIGS. 2 and 3). All those key structural features have to be intact for proper enzyme functionality, that is, RNA capping. Therefore, any coupling strategy should fulfill prerequisites for successful capping enzyme immobilization as exemplified below.

Cap-specific nucleoside 2'-O-methyltransferase have, besides other important structural features, binding pockets for substrates (cap0 RNA), and RNA binding grooves or surfaces, and active sites for methylation (FIG. 7). All those key structural features have to be intact for proper enzyme functionality. Therefore, any coupling strategy should fulfill prerequisites for successful cap-specific nucleoside 2'-O-methyltransferase immobilization as exemplified below.

(I) Enzymes should retain or enhance their biological activity after coupling.
(II) Immobilized enzymes should have similar or even a better long-term stability and thermal stability, leading to a longer shelf life.
(III) The sensitivity and reactivity of the enzyme should be preserved after immobilization.
(IV) The immobilization procedure should be strong enough and stable enough to minimize enzyme leakage or leakage of the support material or leakage of other chemicals involved in the immobilization process.

In principle, coupling strategies mainly comprise, but are not limited to, entrapment/encapsulation, physical adsorption, bio-affinity interactions, and formation of a covalent bond. A schematic representation of possible immobilization strategies for the capping enzyme and the cap-specific nucleoside 2'-O-methyltransferase of the present invention is shown in FIG. 1.

An immobilization support may comprise metals, silicon, glass, polydimethylsiloxane (PDMS), plastic materials, porous membranes, papers, alkoxysilane-based sol gels, agarose, Sepharose™, polymethylacrylate, methacrylate, polyacrylamide, cellulose, and silica, monolithic supports, and expanded-bed adsorbents. The choice of a suitable support material largely depends on the coupling strategy. Therefore potential support materials are mentioned in the context of the respective coupling strategy.

The basic principle of protein entrapment/encapsulation is that the respective enzyme may be encapsulated in the interior of the respective support material, which may prevent enzyme aggregation and enzyme denaturation.

Possible support materials comprise polyacrylamide gels, sol-gels, lipid vesicles and polymers such as poly (lactic acid) and poly (lactic-co-glycolic acid).

Physical adsorption, where the respective enzyme may bind passively on a particular support material, is based on physical forces such as electrostatic, hydrophobic, van der Waals, and hydrogen bonding interactions. Physical adsorption is based on random binding of the respective enzyme on multiple anchoring points to the support material.

Possible support materials comprise metal, silicon, glass, PDMS, and various adhesive plastic materials.

Bio-affinity immobilization strategies exploit the affinity interactions of different biological systems comprising the avidin-biotin system, and affinity capture ligands (His/GST tags).

In the widely employed avidin-biotin strategy, partners for biomolecules are avidin (tetrameric glycoprotein from chicken eggs), or neutravidin (deglycosylated version of avidin), or streptavidin (a protein form *Streptomyces avidinii* with higher affinity than avidin) and biotin (water soluble vitamin-B) that form strong non-covalent interactions. Biotinylated moieties strongly bind avidin or streptavidin. Biotinylation, that is the conjugation of biotin on molecules particularly proteins, does usually not affect functionality or conformation due to its small size. Capping enzyme or cap-specific nucleoside 2'-O-methyltransferases may be chemically or enzymatically biotinylated. Most chemical biotinylation reagents consist of a reactive group attached via a linker to the valeric acid side chain of biotin. As the biotin binding pocket in avidin or streptavidin is buried beneath the protein surface, biotinylation reagents possessing a longer linker are desirable, as they enable the biotin molecule to be more accessible to binding avidin or streptavidin protein. Chemical biotinylation may occur on several moieties in the respective enzyme including primary amines (—NH2), thiols (—SH, located on cysteines) and carboxyls (—COOH, a group located at the C-terminus of each polypeptide chain and in the side chains of aspartic acid and glutamic acid). All these above mentioned biotinylation targets in a protein can be used, depending on the respective buffer and pH conditions. For example, free thiol groups (sulfhydryl groups, —SH, located on cysteine side chains) are less prevalent on most proteins. Biotinylation of thiol groups is useful when primary amines are located in the regulatory domain(s) of the target protein or when a reduced level of biotinylation is required. Thiol-reactive groups such as maleimeides, haloacetyls and pyridyl disulfides require free thiol groups for conjugation; disulfide bonds must first be reduced to free up the thiol groups for biotinylation. If no free thiol groups are available, lysines can be modified with various thiolation reagents (Traut's Reagent, SAT (PEG4), SATA and SATP), resulting in the addition of a free sulfhydryl. Thiol biotinylation is performed in a pH range of 6.5-7.5.

Possible support materials for immobilizing capping enzymes and cap-specific nucleoside 2'-O-methyltransferases using the biotin-avidin strategy comprise, but are not limited to, agarose, Sepharose™, glass beads, which are coated with avidin or streptavidin. Particularly preferred is agarose and Sepharose™ as support material.

Affinity capture ligands comprise, but are not limited to, oligohistidine-tag (His) and (glutathione-S-transferase) GST tags.

The C- or N-terminus of capping enzymes and/or cap-specific nucleoside 2'-O-methyltransferases may be genetically engineered to have a His segment that specifically chelates with metal ions (e.g., Ni2þ). Ni2þ is then bound to another chelating agent such as NTA (nitriloacetic acid), which is typically covalently bound to an immobilization support material. The controlled orientation of respective enzyme may be facilitated, as the His tags can in principal be placed to the C- or N-terminus of each protein.

Possible support materials comprise, but are not limited to, various nickel or cobalt chelated complexes, particularly preferred are nickel-chelated agarose or Sepharose™ beads.

In the art, the catalytic polypeptide of VV capping enzyme has been purified via an introduced oligo histidine tag and via interaction with nickel on a column for purification purposes. The captured, immobilized capping enzyme has not been further analyzed e.g. for its enzymatic function. The purified capping enzyme has been used for structural characterization studies (Kyrieleis et al. (2014) Structure 22(3): 452-465).

GST (glutathione S-transferase) may be tagged onto the C- or N-terminus (commonly the N-terminus is used) of the capping enzyme and/or cap-specific nucleoside 2'-O-methyltransferase by genetic engineering. The result would be a GST-tagged fusion protein. GST strongly binds to its substrate glutathione. Glutathione is a tripeptide (Glu-Cys-Gly) that is the specific substrate for glutathione S-transferase (GST). When reduced glutathione (G233SH) is immobilized through its thiol group to a solid support material, such as cross-linked beaded agarose or Sepharose™, it can be used to capture GST-tagged enzymes via the enzyme-substrate binding reaction.

Possible support materials comprise, but are not limited to, glutathione (GSH) functionalized support materials, particularly GSH-coated beads, particularly preferred GSH-coated agarose or Sepharose™.

Preferably, the capping enzyme or the cap-specific nucleoside 2'-O-methyltransferase is immobilized onto the solid support by covalent binding.

Covalent immobilization is generally considered to have the advantage that the protein which is to be immobilized and the corresponding support material have the strongest binding, which is supposed to minimize the risk of proteins to dissociate from the support material, also referred to as enzyme leakage.

To achieve covalent binding of the capping enzyme or cap-specific nucleoside 2'-O-methyltransferases to the support material, the respective support material has to be chemically activated via reactive reagents. Then, the activated support material reacts with functional groups on amino acid residues and side chains on the enzyme to form covalent bonds.

Functional groups on the capping enzyme or cap-specific nucleoside 2'-O-methyltransferase suitable for covalent binding comprise, but are not limited to, primary amines (—NH2) existing at the N-terminus of each polypeptide chain and in the side-chain of lysine (Lys, K), α-carboxyl groups and the β- and γ-carboxyl groups of aspartic and glutamic acid, and sulfhydryl or thiol groups of cysteines. These functional groups are preferably located on the solvent exposed surface of the correctly 3 dimensionally folded capping enzyme or cap-specific nucleoside 2'-O-methyltransferase.

Primary amines (—NH2) provide a simple target for various immobilization strategies. This involves the use of chemical groups that react with primary amines. Primary amines are positively charged at physiologic pH; therefore, they occur predominantly on the outer surfaces of the protein, therefore, such groups are mostly accessible to immobilization procedures.

Suitable support materials for immobilization via primary amines comprise, but are not limited to, formaldehyde and glutaraldehyde activated support materials, 3-aminopropyl-triethoxysilane (APTES) activated support materials, cyanogen bromide (CnBr) activated support materials, N-hydroxysuccinimide (NHS) esters and imidoesters activated support materials, azlactone activated support materials, epoxy activated support materials and carbonyl diimidazole (CDI) activated support materials.

The carboxyl group is a frequent moiety (—COOH) at the C-terminus of each polypeptide chain and in the side chains of aspartic acid (Asp, D) and glutamic acid (Glu, E), usually located on the surface of protein structure. Carboxylic acids may be used to immobilize capping enzymes or cap-specific nucleoside 2'-O-methyltransferases through the use of a carbodiimide-mediated reaction. 1-ethyl-3-(3-dimethylaminopropyl) carbodiimide (EDC) and other carbodiimides cause direct conjugation of carboxylates (—COOH) to primary amines (—NH2).

Possible support materials comprise, but are not limited to, diaminodipropylamine (DADPA) agarose resin that allow direct EDC-mediated crosslinking, which usually causes random polymerization of proteins or epoxy-activated supports In a preferred embodiment of the invention, covalent immobilization is via a unique and mutually reactive group on the protein's surface (e.g., thiol group of cysteine) and the solid support (e.g., thiol activated solid support, such as thiol or maleimide activated sepharose or epoxy activated supports such as epoxy methacrylate). Furthermore, the reaction between the two reactive groups should be highly selective. Also, the coupling reaction should work efficiently under physiological conditions (i.e., in aqueous buffers around neutral pH) to avoid the denaturation of the protein during the immobilization step. Finally, it is desirable that the reactive group on the protein can be obtained using recombinant protein expression techniques or is already naturally present on the protein's surface.

Many reactive groups used for covalent immobilization (see above) are commonly present multiple times in a protein. Due to the strong nature of covalent bonds, multiple bonds could, however, alter the 3-D conformation or destroy the catalytic core or other relevant protein domains. Therefore, complicated chemistry is often required to achieve oriented immobilization of enzymes (e.g., chemical blocking of other reactive groups in the enzyme such as ethanolamine to block excessive reactive amine groups). Site-specific covalent immobilization would allow the enzymes to be immobilized in a definite, oriented fashion. However, this process requires the presence of unique and mutually reactive groups on the protein (e.g., thiol group of cysteine) and the support (e.g., thiol activated Sepharose™, epoxy activated methacrylate). Furthermore, the reaction between the two reactive groups should be highly selective. Also, the coupling reaction should work efficiently under physiological conditions (i.e., in aqueous buffers around neutral pH) to avoid the denaturation of the protein during the immobilization step. Finally, it is desirable that the reactive group on the protein can be obtained using recombinant protein expression techniques.

Sulfhydryl groups, also called thiol groups, which have the structure R—SH, allow a selective immobilization of proteins and peptides as they commonly occur in lower frequencies (Hansen et al. (2009) Proc. Natl. Acad. Sci. USA 106(2): 422-427). Thiol groups may be used for direct immobilization reactions of capping enzymes or cap-specific nucleoside 2'-O-methyltransferases to activated support materials, forming either thioether linkages (R—S—R) prepared by the alkylation of thiol or disulfide bonds (R—S—S—R) derived from coupling of two thiol groups. The thiol groups necessary for those reactions may have different sources:

a) Thiol groups of inherent or native free cysteine residues.
b) Often, as part of a protein's secondary or tertiary structure, cysteine residues are joined together between their side chains via disulfide bonds. Thiol groups can be generated from existing disulfide bridges using reducing agents.
c) Thiol groups can be generated through the use of thiolation reagents, which add thiol groups to primary amines.
d) Thiol groups can be genetically introduced by adding a cysteine residue at the C- or N-terminus or substituting an amino acid residue within the protein with another amino acid, particularly a cysteine. Thiol groups may also be introduced by introducing a cysteine residue into the natural amino acid sequence, preferably in a region of the protein which is neither important for the catalytic activity of the protein nor important for its structural integrity, such as often loop or turn structures.

In a preferred embodiment, capping enzymes and cap-specific 2'-O-methyltransferases are covalently coupled via the thiol groups of cysteine (native or introduced) to a suitable support material, more preferably they are coupled via disulfide bonds to a thiol-activated support material or via a thioether bond to a maleimide-activated solid support, a pyridyl disulfide-functionalized solid support or an epoxy activated support. Most preferably, the capping enzymes and cap-specific 2'-O-methyltransferases are covalently coupled via the thiol groups of cysteine via a thioether bond to an epoxy activated support.

Thiol-activated support material contains chemical groups which are capable of reacting with the thiol group of a cysteine of the capping enzyme and/or cap-specific 2'-O-methyltransferase, such as maleimides, epoxy, haloacetyls and pyridyl disulfides. Suitable solid supports include thiol Sepharose™, thiopropyl-Sepharose™, thiol-activated Sephadex™, thiol-activated agarose, silica-based thiol-activated matrix, silica-based thiol-activated magnetic beads and epoxy methacrylate beads. Specific examples of thiol-activated Sepharose™ include Thiol Sepharose 4B HiTrap™, Thiol Sepharose 4B™ or Thiol Sepharose 6B™, available, for example, from GE Healthcare Life Sciences. Suitable pyridyl disulfide-functionalized supports include nanoparticles such as Nanosprings® of STREM chemicals or any amine-containing support thiolated by an N-Hydroxysuccinimide-pyridyl disulfide like NHS-PEG$_4$-pyridyl disulfide. In further examples, the solid support comprises pyridyl disulfide-functionalized nanoparticles and/or maleimide-activated agarose. In further preferred examples, the solid support comprises epoxy activated methacrylate beads.

The solid support may be a mixture of the solid supports mentioned herein. However, it is preferred to have the same functional group presented on the solid support, i.e. the thiol group. For example, in one single enzyme reactor thiol Sepharose™, thiopropyl-Sepharose™ and thiol-activated Sephadex™, may be used for immobilization of the capping enzyme and/or the cap-specific nucleoside 2'-O-methyltransferase.

Preferably, the solid support is selected from the group consisting of activated thiol sepharose, thiopropyl-sepharose, thiol-activated sephadex, thiol-activated agarose, silica-based thiol-activated matrix, silica-based thiol-activated magnetic beads, pyridyl disulfide-functionalized nanoparticles, maleimide-activated agarose, epoxy activated methacrylate and mixtures thereof.

The inventors consider this strategy to be generally advantageous because, commonly, only a low number of free existing thiol groups exist in the protein primary structure of enzymes (Hansen et al. (2009) Proc. Natl. Acad. Sci. USA 106(2): 422-427).

This allows for a virtually site-specific and efficient way of immobilization, that is oriented immobilization. Such an oriented immobilization is preferred. Additionally, this immobilization strategy may avoid multiple coupling events to the support material which may lead to steric hindrances or other disturbances which may eventually decrease enzyme stability, reactivity and specificity. Moreover, the covalent coupling via thiol groups of the respective enzymes may have the advantage of a very strong bond that, most importantly, minimizes the danger of an uncontrolled dissociation of support material and enzyme.

If a capping enzyme or a cap-specific nucleoside 2'-O-methyltransferase may be covalently coupled via the thiol group of cysteine to the support material, several aspects should be considered by a person skilled in the art:

I) If several cysteine residues are present in the primary protein structure, free thiol groups, meaning cysteine residues not linked to other cysteine residues via disulfide bridges, may be identified using disulfide bridge prediction algorithms (Yaseen, Ashraf, and Yaohang Li. *BMC bioinformatics* 14.Suppl 13 (2013): S9.).

II) The free existing thiol groups should not be present in catalytically important areas, the dimerization or multimerization surface, the RNA-binding domain or other functional relevant parts of the enzymes due to the potential problems caused, as explained above. A person skilled in the art may first conduct the present literature on the structure of capping enzymes and cap-specific 2'-O-methyltransferases or literature on structure-function relationships to identify such potential cysteine residues.

III) If several free thiol groups are present in the primary sequence of the protein, that are not located in catalytically important areas, the dimerization or multimerization surface, the RNA-binding domain or other functional relevant parts of the enzymes, respective cysteines may be substituted for a different amino acid, preferably serine, valine or alanine, preferably by genetic means. This may help to avoid multiple coupling events to the support which might lead to steric hindrances or other disturbances that could eventually decrease enzyme stability, reactivity and specificity. Protein visualization tools (e.g., PDB viewer, Guex, N. and Peitsch, M. C. (1997) Electrophoresis 18: 2714-2723) may help a person skilled in the art to decide whether respective cysteine residues should be substituted in the respective enzyme. Moreover, the effect of certain cysteine substitutions/point mutations can also be estimated by using prediction tools, including Rost et al. (2004) *Nucl. Acids Res.* 32.suppl 2: W321-W326).

IV) If free thiol groups are present in the primary structure of the respective enzyme, a person skilled in the art may also use recent literature on the respective protein structure, if available, to assess if these cysteine residues are accessible for chemical interactions (i.e., covalent bond to a support material), or if these cysteine residues are buried in the interior of the protein 3-D structure. A person skilled in the art may use algorithms to predict if a respective cysteine is buried or freely accessible by performing calculations comprising residue depth calculations or solvent-accessible surface area calculations (Xu, Dong, Hua Li, and Yang Zhang. *Journal of Computational Biology* 20.10 (2013): 805-816). Alternatively, the skilled person may easily employ any of the immobilization strategies described herein and test the capping enzyme and/or the cap-specific 2'-O-methyltransferases for its catalytic activity.

V) If no freely accessible cysteine residues are present in the primary structure of the respective enzyme, cysteine residues may be introduced by various means. For example, cysteine residues may be introduced at the N-terminus or C-terminus of the capping enzyme and/or cap-specific nucleoside 2'-O-methyltransferases by methods comprising genetic engineering, either by extending the N-terminus or the C-terminus or by substitution of the N-terminal-most or C-terminal-most amino acid. Moreover, a person skilled in the art may introduce flexible linkers, in particular, if the N- or C-terminus of the respective enzyme displays important functional or structural features (Chen, Xiaoying, Jennica L. Zaro, and Wei-Chiang Shen. *Advanced drug delivery reviews* 65.10 (2013): 1357-1369). Again, cysteine residues may also be introduced in any other suited regions of the protein by substitution of amino acids. Ideally, such residues should be located at the protein surface and possibly in loop or turn structures which often do not play a role in the protein's structural integrity or are relevant for its enzymatic activity. Preferably, an amino acid that occupies a similar space in a protein's 3-D structure, such as serine, may be considered for an S to C substitution and vice versa if cysteine residues are to be removed.

VI) If the respective enzyme to immobilize is a multimer e.g. a heterodimer such as the capping enzyme of Vaccinia virus, oriented immobilization may require the coupling of one hetrerodimeric partner to the support (e.g., the D12 subunit of Vaccinia virus capping enzyme) prior to a heterodimerization step with the other partner (e.g. the D1 subunit of Vaccinia virus capping enzyme). Alternatively, both heterodimeric partners may be immobilized using any of the above immobilization mentioned strategies. Additionally, fusion proteins of the subunits (D1-D12 or D12-D1) may be generated and immobilized using any of the above mentioned immobilization strategies.

In a first aspect of the present invention, any known eukaryotic or viral capping enzyme or unit of capping enzyme complex may be immobilized. Preferably, the capping enzyme has RNA triphosphatase (TPase), guanylyltransferase (GTase) and methyltransferase (MTase) activity independent of RNA polymerase II (see FIG. 4). The polypeptide harboring the catalytic domains is herein also referred to as "catalytic polypeptide" (e.g., in case of the Vaccinia virus capping enzyme, subunit D1)

More preferred are capping enzymes of ds DNA eukaryotic viruses comprising Poxviridae (Vaccinia virus, Cowpox virus, Taterapox virus, Camelpox virus, Tetrapox virus, Monkeypox virus, Ectromelia virus, Variola virus, Raccoonpox virus, Yoka poxvirus, Swinepox virus, Yaba monkey tumor virus, Deerpox virus, Myxoma virus, Goatpox virus, Lumpy skin disease virus, Sheeppox virus, Squirrelpox virus, Cotia virus, Molluscum contagiosum virus, Parapoxvirus red deer, Bovine papular stomatitis virus, orf virus, Pseudocowpox virus, Turkeypox virus, Canarypox virus, Penguinpox virus, Fowlpox virus, Nile crocodilepox virus, Salmon gill poxvirus, Anomala cuprea entomopoxvirus, Melanoplus sanguinipes entomopoxvirus, Amsacta moorei entomopoxvirus, Mythimna separata entomopoxvirus, Choristoneura rosaceana entomopoxvirus, Choristoneura biennis entomopoxvirus, Adoxophyes honmai entomopoxvirus, Rabbit fibroma virus), from Mimiviridae (Mimivirus, Acanthamoeba polyphaga mimivirus, Moumouvirus goulette, Megavirus chiliensis, Moumouvirus Monve), from Baculoviridae (Peridoma alphabaculovirus, Baculovirus), and from Chlorovirus (Paramecium bursaria Chlorella virus, Acanthocystis turfacea Chlorella virus, Micromonas pusilla virus, Ostreococcus tauri virus).

The amino acid sequence of the catalytic polypeptide of Cowpox virus is available under UniProt Accession No. Q8QMV9 and the amino acid sequence of the catalytic polypeptide of Camelpox virus is available under UniProt Accession No. Q8V2R8. The amino acid sequence of the catalytic polypeptide of rabbit fibroma virus is available under UniProt Accession No. P25950 and the amino acid sequence of the catalytic polypeptide of Fowlpox virus is available under UniProt Accession No. Q9J584.

Examples of suitable catalytic polypeptides of capping enzymes derived from eukaryotic viruses are depicted in the SEQ ID NOs: 1 and 61-97.

Examples of suitable regulatory polypeptides of capping enzymes derived from eukaryotic viruses are depicted in SEQ ID NOs: 2 and 98-127.

Most preferred is the capping enzyme of Vaccinia virus (FIGS. 2 and 3) that executes all catalytic steps, i.e. in the capping process, i.e. it has RNA triphosphatase (TPase), guanylyltransferase (GTase) and methyltransferase (MTase) activity independent of RNA polymerase II.

Vaccinia virus (VV) capping enzyme is a heterodimer of the catalytic polypeptide D1 (844 aa; see SEQ ID NO: 1) and the regulatory polypeptide D12 (287 aa; see SEQ ID NO: 2) that executes all three steps in m7GpppRNA synthesis in the presence of a methionine donor (S-adenosylmethionine (SAM)) and GTP under suitable buffer conditions (FIG. 2-FIG. 4). The enzymatic activities (TPase, GTase, NTase, MTase) of the VV capping enzyme are located on the large D1 polypeptide chain (catalytic polypeptide), whereas the methyltransferase activity is allosterically stimulated by the short D12 polypeptide chain (regulatory polypeptide). Hence, it is particularly preferred to covalently couple the capping enzyme via a thiol group of an introduced or a natively occurring cysteine on the D12 polypeptide chain (regulatory polypeptide) to a suitable activated support material.

Both wild-type VV polypeptides D1 and D12 harbor several different cysteine residues (FIG. 5 and SEQ ID NOs: 1 and 2). D1 polypeptide harbors six different native cysteine residues (C119, C277, C342, C458, C581, C824), and the D12 polypeptide harbors four native cysteine residues (C153, C173, C184, C202).

In one embodiment, the VV D1/D12 heterodimer is immobilized to a suitable activated support material using natively occurring thiol groups, resulting in a (randomly) immobilized VV capping enzyme heterodimer, coupled to a suitable activated support material.

In one embodiment, all natively occurring cysteine residues in VV D1 and/or D12 polypeptide may be substituted with any other amino acid, most preferably with V, S, or A. Exemplary D1 polypeptides (catalytic polypeptide) in which all natively occurring cysteine residues as defined above have been substituted with another amino acid are shown in SEQ ID NOs: 6 and:161-197 and exemplary D12 polypeptides (regulatory polypeptide) in which all natively occurring cysteine residues have been substituted with another amino acid are shown in SEQ ID NOs: 4 and 198-227. If all natively occurring cysteine residues have been mutated to another amino acid, a cysteine residue has to be added to the D1 and/or D12 polypeptide to enable the immobilization to the solid support. Preferably, the cysteine residue is added to the C-terminus of the D1 and/or D12 polypeptide. The cysteine residue may be added to the C-terminus via a linker which may essentially consist of glycine residues. Exemplary D1 polypeptides (catalytic polypeptide) in which all natively occurring cysteine residues as defined above have been substituted with another amino acid and to which a C-terminal cysteine has been added are shown in SEQ ID NOs: 7 and 261-297 and exemplary D12 polypeptides (regulatory polypeptide) in which all natively occurring cysteine residues have been substituted with another amino acid and to which a C-terminal cysteine has been added are shown in SEQ ID NOs: 5 and 298-327.

In another preferred embodiment, a mutant D1 polypeptide, where five of the six natively occurring cysteine residues as defined above are substituted with another amino acid, preferably with V, S, or A is immobilized to a suitable activated support via a thiol group of the remaining natively occurring cysteine, and a mutant D12 polypeptide where three of the four natively occurring cysteine residues as defined above are substituted with another amino acid, preferably with V, S, or A is immobilized to a suitable activated support via a thiol group of the remaining natively occurring cysteine, resulting in a heterodimer where each heterodimeric partner is immobilized to a suitable activated support material.

In another preferred embodiment a mutant D1 polypeptide, where all natively occurring cysteine residues as defined above are substituted with V, S, or A is immobilized via a thiol group of a C-terminally introduced cysteine residue, preferably introduced via a C-terminal flexible linker element, and a mutant D12 polypeptide where three of the four natively occurring cysteine residues are substituted to V, S, or A is immobilized via a thiol group of the remaining natively occurring cysteine to a suitable activated support, resulting in a heterodimer where each heterodimeric partner is immobilized to a suitable activated support material.

Examples of suitable linker elements are depicted in SEQ ID NOs: 15-39. These linker elements are preferably introduced at the C-terminus of the catalytic polypeptide.

In other embodiments, the catalytic polypeptide where all natively occurring cysteine residues as defined above are substituted with another amino acid, preferably with V, S, or A may be derived from other viruses and is preferably selected from SEQ ID NOs: 161-197. The mutated catalytic polypeptide is immobilized via an introduced cysteine residue, preferably via a C-terminally introduced cysteine residue, more preferably via a C-terminal linker element comprising a C-terminal cysteine residue, wherein the C-terminal linker element comprising a C-terminal cysteine residue may be selected from any one of SEQ ID NOs: 15-39. Catalytic polypeptides wherein all natively occurring cysteine residues as defined above are substituted with another amino acid, preferably with V, S, or A, and to which a cysteine residue has been introduced at the C-terminus are depicted in SEQ ID NOs: 261-297.

In another preferred embodiment, a mutant D12 polypeptide, where all natively occurring cysteine residues are substituted with another amino acid, preferably with V, S, or A is immobilized to a suitable activated support via a thiol group of a C-terminally introduced cysteine residue, preferably introduced via a C-terminal flexible linker element, and a mutant D1 polypeptide where five of the six natively occurring cysteine residues are substituted with another amino acid, preferably with V, S, or A is immobilized to a suitable activated support via a thiol group of the remaining natively occurring cysteine to a suitable activated support, resulting in a heterodimer where each heterodimeric partner is immobilized to a suitable activated support material. Preferably, the mutant D12 polypeptide and the mutant D1 polypeptide are immobilized to the same activated support.

Examples of suitable linker elements are depicted in SEQ ID NOs: 15-39. These linker elements are preferably introduced at the C-terminus of the regulatory polypeptide.

In other embodiments, the regulatory polypeptide where all six natively occurring cysteine residues as defined above are substituted with another amino acid, preferably with V, S, or A may be derived from other viruses and is preferably selected from SEQ ID NOs: 198-227. The mutated regulatory polypeptide is immobilized via an introduced cysteine residue, preferably via a C-terminally introduced cysteine residue, more preferably via a C-terminal linker element comprising a C-terminal cysteine residue, wherein the C-terminal linker element comprising a C-terminal cysteine residue may be selected from any one of SEQ ID NOs: 15-39.

In another preferred embodiment a mutant D1 polypeptide (catalytic polypeptide), where all natively occurring cysteine residues as defined above are substituted with another amino acid, preferably with V, S, or A is immobilized to a suitable activated support material via a thiol group of a C-terminally introduced cysteine residue, preferably introduced via a C-terminal flexible linker element, and a mutant D12 polypeptide (regulatory polypeptide) where all natively occurring cysteine residues are substituted with another amino acid, preferably with V, S, or A is immobilized to a suitable activated support material via a thiol group of a C-terminally introduced cysteine residue, preferably introduced via a C-terminal flexible linker element to a suitable activated support, resulting in a heterodimer where each heterodimeric partner is immobilized to a suitable activated support material. Preferably, the mutant D12 polypeptide and the mutant D1 polypeptide are immobilized to the same activated support.

The D12 polypeptide has only an allosteric effect on the MTase activity of the D1 polypeptide, but does not have a catalytic activity itself. Therefore, it is preferred to use the D12 polypeptide for mutagenesis and subsequent immobilization, since substitution of the cysteine residues in D12 is neutral for the overall enzymatic capping activity. The heterodimerization with the D1 catalytic polypeptide may be performed before or after immobilization of the D12 polypeptide, preferably it is performed after immobilization. The heterodimerization is preferably performed in the buffer used for immobilization, e.g. in a buffer containing 0.1 M Tris-HCl pH 7.5, 0.5 M NaCl, 1 mM EDTA for two hours at room temperature.

The VV D12 polypeptide harbors four native cysteine residues (C153, C173, C184, C202). For an oriented and controlled immobilization, only one cysteine residue with one freely accessible thiol group would be desired.

In a particularly preferred embodiment, the mutant D12 polypeptide where three of the four natively occurring cysteine residues are substituted with V, S, or A is immobilized to a suitable activated support via a thiol group of the remaining native cysteine. Mutant D12 polypeptides as disclosed herein are coupled to a suitable support material preferably before heterodimerization with wild type D1 to facilitate oriented immobilization.

In another particularly preferred embodiment, the mutant D12 polypeptide where all four natively occurring cysteine residues are substituted with V, S, or A is immobilized to a suitable activated support via a thiol group of an introduced C-terminal cysteine residue, preferably introduced via a C-terminal flexible linker. Mutant D12 polypeptides as disclosed herein are coupled to a suitable support material preferably before heterodimerization with wild-type D1 to facilitate oriented immobilization.

In another preferred embodiment, the D12 and D1 polypeptides of the Vaccinia virus capping enzyme are fused via a linker to generate one polypeptide chain comprising both the D1 and the D12 polypeptide. Any suitable linker may be used to generate a fusion protein (Chen et al. (2013) *Advanced drug delivery reviews* 65(10): 1357-1369). Particular examples of suitable linkers for preparing the fusion proteins are depicted in SEQ ID NOs: 361-385.

In a preferred embodiment, the D1 and D12 polypeptides are fused via a linker element, preferably a linker consisting essentially of glycine and serine residues and more preferably a (GGGGS)$_3$ linker. Examples of such fusion proteins are shown in FIG. 6 and depicted in SEQ ID NOs: 8, 9 and 10. The fusion protein is immobilized to a suitable activated support material using natively occurring thiol groups, resulting in a (randomly) immobilized VV capping enzyme D1•D12 fusion protein, coupled to a suitable activated support material.

In a preferred embodiment, the D12 and D1 polypeptides are fused via a linker element, preferably a linker consisting essentially of glycine and serine residues and more preferably a (GGGGS)$_3$ linker, and immobilized to a suitable activated support material using natively occurring thiol groups, resulting in a (randomly) immobilized VV capping enzyme D12•D1 or D1•D12 fusion protein, coupled to a suitable activated support material.

In a preferred embodiment, mutant D1 and D12 polypeptides are fused via a linker element, preferably a linker consisting essentially of glycine and serine residues and more preferably a (GGGGS)$_3$ linker. At least 9 of the 10 natively occurring cysteine residues in the D1•D12 fusion protein are substituted with V, S, or A, resulting in an VV capping enzyme, immobilized to a suitable activated support material via a natively occurring thiol group of the remaining cysteine.

In a preferred embodiment, mutant D12 and D1 polypeptides are fused via a linker element, preferably a linker consisting essentially of glycine and serine residues and more preferably a (GGGGS)$_3$ linker and at least 9 of the 10 natively occurring cysteine residues in the D12•D1 fusion protein are substituted to V, S, or A. This fusion protein is immobilized to a suitable activated support material via at least one natively occurring thiol group of the remaining cysteine residue.

In a preferred embodiment, mutant D1 and D12 polypeptides are fused via a linker element, preferably a linker consisting essentially of glycine and serine residues and more preferably a (GGGGS)$_3$ linker. All 10 natively occurring cysteine residues in the D1•D12 or D12•D1 fusion protein are substituted with V, S, or A, and an additional cysteine is introduced at the C-terminus of the fusion protein, preferably via a linker, such as any of the linkers shown in SEQ ID NOs: 15 to 39. This fusion protein is immobilized to a suitable activated support material via the thiol group of the introduced C-terminal cysteine.

In a second aspect of the present invention, a cap-specific nucleoside 2'-O-methyltransferase is immobilized.

Preferred are cap-specific nucleoside viral 2'-O-methyltransferases, particularly from dsDNA viruses including Ectromelia virus, Monkeypox virus, Cowpox virus, Variola virus, Vaccinia virus, Megavirus chiliensis, Naegleria gruberi, Acanthamoeba castellanii mamavirus, Taterapox virus, Camelpox virus, Tetrapox virus, Ectromelia Raccoonpox virus, Yoka poxvirus, Swinepox virus, Yaba monkey tumor virus, Deerpox virus, Myxoma virus, Goatpox virus, Lumpy skin disease virus, Sheeppox virus, Squirrelpox virus, Cotia virus, Molluscum contagiosum virus, Parapoxvirus red deer, Bovine papular stomatitis virus, orf virus, Pseudocowpox virus, Turkeypox virus, Canarypox virus, Penguinpox virus, Fowlpox virus, Nile crocodilepox virus, Salmon gill poxvirus, Anomala cuprea entomopoxvirus, Melanoplus sanguinipes entomopoxvirus, Amsacta moorei entomopoxvirus, Mythimna separata entomopoxvirus, Choristoneura rosaceana entomopoxvirus, Choristoneura biennis entomopoxvirus, Adoxophyes honmai entomopoxvirus and Rabbit fibroma virus.

The amino acid sequence of the cap-specific nucleoside viral 2'-O-methyltransferase from Fowlpox virus is available under UniProt Accession No. P15916 and the amino acid sequence of the cap-specific nucleoside viral 2'-O-methyltransferase from Variola virus is available under UniProt Accession No. P33052.

Examples of suitable cap-specific nucleoside 2'-O-methyltransferase derived from eukaryotic viruses according to the invention are SEQ ID NOs: 128-160. Functional fragments, derivatives and variants of these sequences are also intended to be included.

Particularly preferred is the cap-specific nucleoside 2'-O-methyltransferase of Vaccinia virus (VP39 protein) according to SEQ ID NO: 3 (FIG. 7) or a functional variant thereof. The Vaccinia virus cap-specific nucleoside 2'-O-methyltransferase protein harbors two native cysteine residues (C178 and C272), see FIG. 8.

In one embodiment, the Vaccinia virus cap-specific nucleoside 2'-O-methyltransferase protein is immobilized using the natively occurring thiol groups to a suitable activated support material, resulting in a (randomly) immobilized enzyme, coupled to a suitable activated support material.

In one embodiment, the natively occurring cysteine residues in the Vaccinia virus cap-specific nucleoside 2'-O-methyltransferase are substituted with any other amino acid, most preferably with V, S, or A (SEQ ID NO: 11).

In a preferred embodiment, a mutant Vaccinia virus cap-specific nucleoside 2'-O-methyltransferase, where one natively occurring cysteine residue is substituted to V, S, or A, is immobilized to a suitable activated support via a thiol group of the remaining cysteine residue.

In another preferred embodiment, a mutant Vaccinia virus cap-specific nucleoside 2'-O-methyltransferase, where all natively occurring cysteine residues (C178 and C272 in the enzyme from Vaccinia virus) are substituted with another amino acid, preferably with V, S, or A (shown in SEQ ID NOs: 12, 328-360), is immobilized via a thiol group of an introduced C-terminal cysteine residue, preferably introduced via a flexible linker, to a suitable activated support.

Examples of suitable linker elements (comprising a C-terminal cysteine) are depicted in SEQ ID NOs: 15-39. These linker elements are preferably introduced at the C-terminus of the cap-specific nucleoside 2'-O-methyltransferase.

In other embodiments, the cap-specific nucleoside 2'-O-methyltransferase where all six natively occurring cysteine residues as defined above are substituted with another amino acid, preferably with V, S, or A may be derived from other viruses and are preferably selected from SEQ ID NOs: 228-260. The mutated cap-specific nucleoside 2'-O-methyltransferase is immobilized via an introduced cysteine residue, preferably via a C-terminally introduced cysteine residue, more preferably via a C-terminal linker element comprising a C-terminal cysteine residue, wherein the C-terminal linker element comprising a C-terminal cysteine residue may be selected from any one of SEQ ID NOs: 15-39.

In specific embodiments, the D1 catalytic polypeptide, and/or the D12 regulatory polypeptide and/or the D1•D12 fusion proteins and/or the D12•D1 fusion proteins and/or the cap-specific nucleoside 2'-O-methyltransferase as defined above additionally harbor at least one purification tag. Said purification tag may be introduced at the N-terminus or the C-terminus of the respective protein. Examples of suitable purification tags according to the invention are depicted in SEQ ID NOs: 40-60, wherein a oligo histidine tag comprising six consecutive histidine residues is preferred (SEQ ID NO: 48).

Within the scope of the present invention not only the native capping enzyme (catalytic or regulatory polypeptide) or cap-specific nucleoside 2'-O-methyltransferase can be used, but also functional variants thereof. Functional variants of the capping enzyme (catalytic or regulatory polypeptide) or cap-specific nucleoside 2'-O-methyltransferase have a sequence which differs from that of the native capping enzyme (catalytic or regulatory polypeptide) or cap-specific nucleoside 2'-O-methyltransferase by one or more amino acid substitutions, deletions or additions, resulting in a sequence identity to the native capping enzyme or cap-specific nucleoside 2'-O-methyltransferase of at least 80%, preferably of at least 81%, 82%, 83%, 84% or 85%, more preferably of at least 86%, 87%, 88%, 89%, 90%, 91%, 92%, 93% or 94%, even more preferably of at least 95%, 96% and most preferably of at least 97%, 98% or 99%.

Variants defined as above are functional variants, if they essentially retain the biological function of the native and naturally occurring enzyme, i.e. the ability to form cap0 in case of the capping enzyme and cap1 structures in case of the cap-specific nucleoside 2'-O-methyltransferase, respectively. The enzyme activity of the functional variant of is at least 50%, 60% or 70%, preferably at least 75%, 80% or 85%, more preferably at least 87%, 89%, 91% or 93% and most preferably at least 94%, 95%, 96%, 97%, 98% or 99% of the native enzyme. The enzyme activity of a variant of the capping enzyme (catalytic or regulatory polypeptide) can be determined by incubating said variant with an RNA, GTP and a suitable methyl donor under suitable conditions and determining the amount of RNA molecules with a cap0 structure in comparison to the amount of RNA molecules with a cap0 structure produced by the native enzyme. The enzyme activity of a variant of the cap-specific nucleoside 2'-O-methyltransferase can be determined by incubating said variant with an RNA having a cap0 structure and a suitable methyl donor under suitable conditions and determining the amount of RNA molecules with a cap1 structure in comparison to the amount of RNA molecules with a cap1 structure produced by the native enzyme.

When the term "functional variant" is used in connection with enzymes from which one or more or all of the natively occurring cysteine residues have been removed or to which a cysteine residue has been added, in particular to the sequences according to any of SEQ ID NOs: 4 to 12, or SEQ ID NOs: 161 to 360 the functional variant has the same number of cysteines on the same location as the enzyme from which the functional variant is derived, in particular the according to any of SEQ ID NOs: 4 to 12 or SEQ ID NOs: 161 to 360.

Further provided is a method for producing the capping enzyme and/or the cap-specific nucleoside 2'-O-methyltransferase of the present invention comprising a step of a) contacting the capping enzyme and/or the cap-specific nucleoside 2'-O-methyltransferase with a solid support under conditions suitable for immobilizing the capping enzyme and/or the cap-specific nucleoside 2'-O-methyltransferase to the solid support by covalent binding, affinity binding, encapsulation, entrapment or physical adsorption as explained above and as exemplified in the Examples section below. Preferably, the immobilization is via a covalent bond. More preferably, the immobilization in step a) leads to the formation of a disulfide bridge or thioether bond. Specifically, it is preferred that step a) comprises the formation of a covalent bond between a cysteine residue of the capping enzyme and/or the cap-specific nucleoside 2'-O-methyltransferase and a thiol group, a haloacetyl group, a pyridyl disulfide an epoxy group or a maleimide group of the solid support. In another preferred embodiment, the solid support is a thiol-activated solid support, a haloacetyl functionalized solid support, pyridyl disulfide-functionalized solid support, epoxy-activated solid support, or maleimide-activated solid support. In a more preferred embodiment, the solid support is an epoxy-activated solid support.

Optionally, the method for producing the capping enzyme and/or the cap-specific nucleoside 2'-O-methyltransferase further comprises prior to contacting the enzyme with a solid support a step of expressing the capping enzyme and/or the cap-specific nucleoside 2'-O-methyltransferase in a suitable expression host. The suitable expression host may be selected from a group consisting of a bacterial cell, a yeast cell or a mammalian cell. Preferably, the expression host is a bacterial cell, more preferably *E. coli*. Protein expression can be performed by standard methods well known to the skilled person such as described in Ceccarelli and Rosano "Recombinant *protein expression in microbial systems*", Frontiers E-books, 2014, Merten "*Recombinant Protein Production with Prokaryotic and Eukaryotic Cells. A Comparative View on Host Physiology*", Springer Science & Business Media, 2001, and others. There are also commercial suppliers who produce capping enzyme and/or the cap-specific nucleoside 2'-O-methyltransferase on demand, such as Genscript, Piscataway, N.J., USA.

Optionally, the method of producing the capping enzyme and/or the cap-specific nucleoside 2'-O-methyltransferase of the present invention further comprises prior to to contacting the enzyme with a solid support and, if present, after the step of expressing the capping enzyme and/or the cap-specific nucleoside 2'-O-methyltransferase in a suitable expression host a step of purifying the capping enzyme and/or the cap-specific nucleoside 2'-O-methyltransferase from an expression host. Protein purification can be performed using purification tags commonly known in the art, e.g. by introducing a purification tag such as a purification tag according to any one of SEQ ID NOs: 40-60 into the capping enzyme and/or the cap-specific nucleoside 2'-O-methyltransferase. Protein purification may also be performed via standard procedures know to the skilled person. Further information can be obtained from Janson "*Protein Purification: Principles, High Resolution Methods, and Applications*", John Wiley & Sons, 2012, and Burgess and Deutscher "*Guide to Protein Purification*", Academic Press, 2009.

Several different approaches exist in the art to bind the respective support material to thiol group containing proteins. Thiol-reactive chemical groups include maleimides, epoxy, haloacetyls, pyridyl disulfides and other disulfide reducing agents. Most of these groups conjugate to thiols on the respective protein by either alkylation (usually the formation of a thioether bond) or disulfide exchange (formation of a disulfide bond). The terms "functionalized" and "activated" with respect to the solid support are used interchangeably and refer to the chemical group which is available on the surface of the solid support for immobilization of the capping enzyme or cap-specific nucleoside 2'-O-methyltransferase.

Maleimide-activated reagents react specifically with thiol groups (—SH) at near neutral conditions (pH 6.5-7.5) to form stable thioether linkages. The maleimide chemistry is the basis for most cross linkers and labeling reagents designed for conjugation of thiol groups. Thiol-containing compounds, such as dithiothreitol (DTT) and beta-mercaptoethanol (BME), must be excluded from reaction buffers used with maleimides because they will compete for coupling sites.

Haloacetyls react with thiol groups at physiological pH. The reaction of the iodoacetyl group proceeds by nucleophilic substitution of iodine with a sulfur atom from a thiol group, resulting in a stable thioether linkage. Using a slight excess of the iodoacetyl group over the number of thiol groups at pH 8.3 ensures thiol selectivity. Histidyl side chains and amino groups react in the un-protonated form with iodoacetyl groups above pH 5 and pH 7, respectively. To limit free iodine generation, which has the potential to react with tyrosine, histidine and tryptophan residues, iodoacetyl reactions and preparations should be performed in the dark.

Pyridyl disulfides react with thiol groups over a broad pH range (the optimum is pH 4 to 5) to form disulfide bonds. During the reaction, a disulfide exchange occurs between the molecule's —SH group and the reagent's 2-pyridyldithiol group. As a result, pyridine-2-thione is released and can be measured spectrophotometrically ($A_{max}$=343 nm) to monitor the progress of the reaction. These reagents can be used as cross linkers and to introduce thiol groups into proteins. The disulfide exchange can be performed at physiological pH, although the reaction rate is slower than at acidic conditions. Further information on pyridyl disulfide reactive groups can be taken from van der Vlies et al. (2010) Bioconjugate Chem. 21 (4): 653-662).

There are several commercially available thiol-activated support materials comprising thiol-activated Sepharose™ such as Thiol Sepharose™ 4B (available from GE Healthcare, Chalfont St Crile, UK) and thiol-activated agarose (available from Cube Biotech, Monheim, Germany) that are preferably be used to immobilize thiol-group-containing capping enzyme or cap-specific nucleoside 2'-O-methyltransferase. Particularly preferred solid support materials are selected from the group consisting of thiol-activated solid support, haloacetyl functionalized solid support, pyridyl disulfide-functionalized solid support, maleimide-activated solid support and mixtures thereof. Most preferred are a thiol-activated solid support and a maleimide-activated solid support. Preferred is a solid support selected from the group consisting of activated thiol Sepharose™, thiopropyl-Sepharose™ thiol-activated Sephadex™, thiol-activated agarose, silica-based thiol-activated matrix, silica-based thiol-activated magnetic beads, pyridyl disulfide-functionalized nanoparticles, maleimide-activated agarose and mixtures thereof. More preferred is a solid support selected from activated thiol Sepharose™, thiopropyl-Sepharose™, thiol-activated Sephadex™, thiol-activated agarose, maleimide-activated agarose (available from Cube Biotech, Monheim, Germany) and other amine containing support thiolated by an N-Hydroxysuccinimide-pyridyl disulfide like NHS-PEG$_4$-pyridyl disulfide. Most preferably, the solid support is thiol Sepharose™ 4B or thiol Sepharose™ 6B.

Another very potent solid support is an epoxy functionalized solid support. Epoxy comprises the functional group as depicted in Formula (I):

(I)

Epoxy-activated matrices can be used for coupling ligands stably through amino, thiol, phenolic or hydroxyl groups depending on the pH employed in the coupling reaction. Immobilization via epoxy groups is also described by Mateo et al. (2000) Biomacromolecules 1(4): 739-745. If the immobilization reaction takes place at a pH between 7.5-8.5, i.e. at physiological conditions, the attachment occurs at thiol groups, if the reaction takes place at a pH between 9 and 11, attachment occurs at amine residues and if the reaction takes place at a pH above 11, the attachment occurs at hydroxyl groups.

Examples of Epoxy-activated resins are Purolite® ECR8205 epoxy methacrylate and Purolite® ECR8214 epoxy methacrylate which are e.g. obtainable from Purolite® Corp., Llantrisant, UK and which are produced via crosslinking in the presence of a porogenic agent that allows the control of porosity, or ECR8204F epoxy-methacrylate beads which are obtainable from Lifetech™, Thermo Fisher Scientific, Waltham, Mass. USA). ECR8204F beads are of 150-300 μm diameter (mean=198) and pores of 300-600 Å.

Epoxy methacrylate resins are particularly preferred for use in the present invention.

Sepharose™-immobilized capping enzyme or cap-specific nucleoside 2'-O-methyltransferase may be re-solubilized using reducing agents such as DTT or mercaptoethanol, or low pH to potentially re-use the support material.

In another aspect the present invention provides a method for producing capped RNA molecules, wherein a capping enzyme immobilized onto a solid support is contacted with RNA molecules to which a cap structure is to be added, a nucleotide and a suitable methyl donor under conditions suitable for forming a cap0 structure.

The capping enzyme is contacted with the RNA molecules, a nucleotide and a suitable methyl donor for at least 5, 10, 15, 20, 25, 30, 35, 40, 45, 50, 55, 60, 65, 70, 75, 80, 85 or 90 minutes, preferably for at least 5 to 120 minutes, more preferably for at least 15 minutes to 90 minutes, even more preferably for at least 30 minutes to 75 minutes and most preferably for one hour. Preferably the temperature used in the capping reaction is 25±3° C., more preferably at 25° C.

The capping reaction may be performed in an aqueous solution comprising a buffer and salts. Preferably the reaction is performed at a pH in the range of 6.5 to 8.5, preferably in the range of 7.0 to 8.3, more preferably, in the range of 7.2 to 8.1 and most preferably at a pH of 8.0.

Suitable buffers for the capping reaction are selected from phosphate buffer, tris buffer, acetate buffer and others. Preferably the buffer is a Tris buffer. Suitable salts that may be included in the reaction mixture together with the capping enzyme, RNA molecules, the methyl donor and the nucleotides are NaCl, KCl, $MnCl_2$, $MgCl_2$ and others. Preferably, the buffer does not contain DTT.

An exemplary capping buffer comprises 50 mM Tris-HCl, 5 mM KCl, 1 mM $MgCl_2$, pH 8.0.

The type of nucleotide which is used in the capping reaction depends on the type of cap structure desired. If a typical cap0 structure is to be formed, the nucleotide is usually GTP. However, alternatively ATP may be used. The nucleotide, preferably GTP, concentration is 1 to 10 mol/l, preferably 3 to 7 mol/l, more preferably 4 to 6 mol/l and most preferably 5 mol/l.

As a methyl donor preferably S-adenosylmethionine (SAM) is used, but other methyl donors may also be used. The concentration of SAM or other methyl donor in the capping reaction is preferably 0.2 to 5 mol/l, preferably 0.5 mol/l to 3 mol/l, more preferably 0.7 mol/l to 2 mol/l and most preferably 1 mol/l.

The RNA which is to be capped is provided in a concentration of 0.1 mg/ml to 1 mg/ml, preferably of 0.2 mg/ml to 0.8 mg/ml, more preferably of 0.3 mg/ml to 0.7 mg/ml and most preferably of 0.5 mg/ml.

Accordingly, one suitable capping reaction mixture comprises 50 mM Tris-HCl, 5 mM KCl, 1 mM $MgCl_2$, pH 8.0, 5 mol/l GTP, 1 mol/l S-adenosylmethionine and 0.5 mg/ml of uncapped RNA.

For the conversion of the cap0 to the cap1 structure by the cap-specific nucleoside 2'-O-methyltransferase the same reaction conditions (time, pH, temperature, buffer, methyl donor) as discussed above for the capping enzyme can be used, except that no GTP is added to the reaction mixture and that RNA having a cap0 structure is used as a substrate.

Accordingly, one suitable reaction mixture for forming Cap1 structures comprises 50 mM Tris-HCl, 5 mM KCl, 1 mM $MgCl_2$, pH 8.0, 1 mol/l S-adenosylmethionine and 0.5 mg/ml of RNA having a cap0 structure.

In another aspect the present invention provides an enzyme reactor comprising immobilized capping enzyme, which is useful for producing RNA having a cap0 structure, preferably for producing in vitro transcribed RNA having a cap0 structure.

Preferably the enzyme reactor contains immobilized VV capping enzyme, particularly preferred is a Sepharose™-immobilized VV capping enzyme or VV capping enzyme immobilized to epoxy methacrylate.

In another aspect, the present invention provides an enzyme reactor comprising immobilized cap-specific nucleoside 2'-O-methyltransferase, which is useful for the enzymatic conversion of a 5' cap0 structure into a 5' cap1 structure, particularly in the production process of in vitro transcribed RNA.

In still another aspect, the enzyme reactor comprises both an immobilized capping enzyme and a cap-specific nucleoside 2'-O-methyltransferase which may also be immobilized.

Optionally, the enzyme reactor further comprises
a) at least one reaction vessel comprising the immobilized capping enzyme and/or the immobilized cap-specific nucleoside 2'-O-methyltransferase,
b) one or more devices for measuring/monitoring and/or adjusting at least one parameter selected from the group consisting of pH, osmolality, salt concentration, such as KCl and magnesium concentration, tris (tris(hydroxymethyl) aminomethane) concentration, temperature, pressure, flow velocity (in-let, outlet-flow), RNA concentration and nucleotide concentration.

In a preferred embodiment, the reaction vessel of the enzyme reactor comprises a thiol-activated solid support, haloacetyl functionalized solid support, pyridyl disulfide-functionalized solid support, epoxy activated solid support, or maleimide-activated solid support. Preferably, the solid support is selected from the group consisting of activated thiol Sepharose™, thiopropyl-Sepharose™, thiol-activated Sephadex™, thiol-activated agarose, silica-based thiol-activated matrix, silica-based thiol-activated magnetic beads, pyridyl disulfide-functionalized nanoparticles, epoxy-methacrylate beads and maleimide-activated agarose.

Optionally, the enzyme reactor comprises one or more devices to introduce and/or remove the components of the capping reaction, such as water, enzyme, RNA molecules, nucleotides, e.g., ATP, UTP, CTP, GTP, nucleotide analogs and mixtures thereof, salts, buffer components etc. into or from the enzyme reactor, in particular the reaction vessel of the enzyme reactor.

Further, to provide for a homogeneous substrate distribution within the reaction vessel, the reaction vessel may comprise a stirring device depending on the solid support which is used for immobilization of the capping enzyme and/or the cap-specific nucleoside 2'-O-methyltransferase. Clearly, the stirring device and stirring speed should be adjusted to minimize shear forces which might negatively affect the immobilization of the capping enzyme and/or the cap-specific nucleoside 2'-O-methyltransferase of the invention. Another method to homogeneously distribute the components of the reaction is a regular movement of the reaction vessel, optionally of the whole enzyme reactor, or a continuous and possibly repeated flow-through of the components of the reaction except of the immobilized capping enzyme and/or the cap-specific nucleoside 2'-O-methyltransferase which stays in the reaction vessel.

Any enzyme reactor known to a skilled person or in the art may be used according to the present invention. In general, an enzyme reactor consists of a vessel or series of vessels, used to perform the desired enzymatic reaction. Hence, the enzyme reactor may contain all reaction components necessary to perform the capping reaction and to produce RNAs with a cap0 or a cap1 structure.

If the enzyme reactor comprises both an immobilized capping enzyme and an immobilized cap-specific nucleoside 2'-O-methyltransferase, it may comprise two separate modules of which one contains the immobilized capping enzyme and one contains the immobilized cap-specific nucleoside 2'-O-methyltransferase. These two modules may be part of the same vessel or container and separated from each other by any suitable means or these two modules may be present in two separate vessels or containers which are connected to each other such that the outlet of the vessel containing the immobilized capping enzyme is connected to the inlet of the vessel containing the immobilized cap-specific nucleoside 2'-O-methyltransferase. Thereby, the outlet of the vessel containing the immobilized capping enzyme provides the substrate for the immobilized cap-specific nucleoside 2'-O-methyltransferase present in the second module.

Important reactor types that may be used for the present invention comprise variants of, but are not limited to, stirred-tank batch reactors, continuous stirred-tank batch reactors, recirculation batch reactors, stirred tank-ultrafiltration reactors, and continuous packed-bed reactors (Illanes, Andrés, ed. *Enzyme biocatalysis: principles and applications*. Springer Science & Business Media, 2008, chapter 5), FIG. 9.

All these reactor types listed above may additionally contain sensors to measure parameters including the operation scale (e.g., inlet flow, outlet flow), pressure, pH, temperature, osmolality, and salinity. All reactors may additionally have heating/cooling devices, pressure devices, and the stirred reactors may contain control elements to control the stirring efficiency. Moreover, some reactors may be connected to a filtration setup, comprising e.g. an ultrafiltration device. In preferred embodiments, the ultrafiltration membrane has a molecular weight cut-off in a range from 10 kDa to 500 MDa, preferably in a range from 50 kDa to 300 MDa, more preferably from 100 kDa to 100 MDa, even more preferably from 500 kDa to 50 MDa, and most preferably from 750 kDa to 25 MDa, such as 1 MDa.

Moreover, some reactors may be connected to a device to determine the capping degree. Moreover, some reactors may be connected to a reaction module for RNA in vitro transcription.

A reactor according to the present invention may include tubes, vessels and other parts (sensors, pumps), manufactured from materials with the following critical characteristics:
- No binding of DNA, RNA or protein
- No contamination of chemicals, especially no leaking of hazardous chemicals (e.g., bisphenol A) or allergens (e.g., heavy metals).
- Materials should not influence enzymatic reactions
- Materials should not lead to a detachment of enzyme and support
- Materials should be non-corrosive Particularly preferred materials comprise, but are not limited to, stainless steel, glass, plastic.

Stirred-tank batch reactors (FIG. 9 A) may consist of a tank containing a rotating stirrer. The tank may be fitted with fixed baffles to improve the stirring efficiency in the tank. The tank may be loaded with the immobilized enzymes (capping enzymes and/or 2'-O-methyltransferase) in a suitable reaction buffer, S-adenosylmethionine, GTP and an uncapped RNA substrate and/or 5' cap0 RNA substrate. In such a reactor, said immobilized enzymes and the substrate RNA molecules have identical residence times. After enzymatic reaction occurred, and after emptying of the batch reactor, the immobilized enzymes and the capped mRNA product (cap0 and/or cap1 RNA) have to be separated. This can be done e.g. by a filter device or membrane with a pore size smaller than the size of the immobilized enzymes and bigger than the size of the mRNA. Alternatively, immobilized enzymes and capped mRNAs may be separated via centrifugation, and eventually, immobilized enzymes may be re-used for several other capping cycles. Alternatively, the reaction vessel comprises a device which allows the direct separation of the immobilized capping enzyme and/or cap-specific nucleoside 2'-O-methyltransferase from the other reaction components so that the capping enzyme and/or cap-specific nucleoside 2'-O-methyltransferase may stay in the reaction vessel.

A stirred-tank batch reactor is particularly preferred in the context of the present invention. In this context it is particularly preferred to use immobilized enzymes e.g. immobilized to Sepharose™ for capping of RNA.

In another preferred embodiment, the capping reactor containing immobilized capping enzyme and/or cap-specific nucleoside 2'-O-methyltransferase is a continuous stirred-tank batch reactor.

Continuous stirred-tank batch reactors (FIG. 9 B) may be constructed similar to stirred-tank batch reactors (see above, FIG. 9 A) with the main difference that continuous flow from inlet and outlet tubes may be applied. One feature of such a reactor type is that the immobilized enzymes and the RNA molecules do not have identical residence times in the reactor. Reaction medium, composed of capping buffer, S-adenosylmethionine, GTP, and RNA, may be pumped into the tank via an inlet that may be located at the bottom of the tank, and reaction buffer containing the capped RNA product may be moved off via an outlet attached at the top. Inlet and outlet flow may be controlled by a pumping device in such a way that the enzymatic reaction can occur. Moreover, outlet tubes may have molecular weight cutoff filters to avoid contamination of the product by immobilized capping enzymes or immobilized cap-specific nucleoside 2'-O-methyltransferases or the immobilized capping enzyme and/or cap-specific nucleoside 2'-O-methyltransferase may be immobilized on a net or a honeycomb like solid structure inside the reaction vessel. One advantage of such an embodiment is that the immobilized enzymes do not have to be separated from the capped RNA product.

In another preferred embodiment, the capping reactor containing an immobilized capping enzyme and/or cap-specific nucleoside 2'-O-methyltransferases is a stirred tank ultrafiltration reactor.

A stirred tank-ultrafiltration reactor (FIG. 3 C) may be constructed similar to stirred-tank batch reactors (see above, cf FIGS. 3 A and 3 B), with the major difference that a small ultrafiltration device is connected to the reaction vessel where the separation of product (capped RNA) and immobilized capping enzyme and/or cap-specific nucleoside 2'-O-methyltransferase takes place. This separation may be facilitated via an ultrafiltration or diafiltration device. In ultrafiltration, the membranes comprise a discrete porous network. The mixed solution is pumped across the membrane, smaller molecules pass through the pores (ATP, RNA) while larger molecules (capped RNA, immobilized capping enzyme and/or cap-specific nucleoside 2'-O-methyltransferase) are retained. Typical operating pressures for ultrafiltration are 1 to 10 bar. The retention properties of ultrafiltration membranes are expressed as molecular weight cutoff (MWCO). This value refers to the approximate molecular weight (MW) of a dilute globular solute (i.e., a typical protein) which is 90% retained by the membrane. However, a molecule's shape can have a direct effect on its retention by a membrane. For example, elongated molecules such as RNA molecules may find their way through pores that will retain a globular species of the same molecular weight (Latulippel and Zydney (2011) Journal of Colloid and Interface Science. 357(2): Pages 548-553). Preferred in this context are cellulose membranes having nominal molecular weight cutoffs of 100 to 300 kDa.

Eventually, the immobilized capping enzyme and/or cap-specific nucleoside 2'-O-methyltransferase may be captured in the ultrafiltration device and returned back to the reaction chamber.

In another preferred embodiment the capping reactor containing an immobilized capping enzyme and/or cap-specific nucleoside 2'-O-methyltransferases is a recirculation batch reactor.

Recirculation batch reactors (FIG. 9 D) may comprise a first vessel, connected via inlet and outlet tubes to a second vessel. The first vessel is loaded with immobilized enzyme. The second chamber contains the capping buffer, S-adenosylmethionine, GTP, and the RNA substrate. In such a recirculating batch reactor, the immobilized enzymes are densely packed in the first vessel or immobilized on a net or honeycomb like solid support through which reaction medium (containing buffer and substrate) is constantly circulating. After enzymatic reaction occurred, the reaction medium, that contains reaction buffer and capped RNA, can be emptied and used for purification of capped RNA, such as by filtration or chromatography. One advantage of such an embodiment is that the immobilized capping enzyme and cap-specific nucleoside 2'-O-methyltransferases do not have to be separated from the capped RNA by other means.

In another preferred embodiment, the capping reactor containing immobilized capping enzyme and/or cap-specific nucleoside 2'-O-methyltransferases is a continuous packed bed reactor.

Continuous packed bed reactors (FIG. 9 E) may consist of a vessel filled with immobilized enzyme. The vessel may be densely packed, thereby forming a bed containing the enzyme immobilized to a solid support. One feature of such a reactor type is that the immobilized enzymes and the RNA molecules do not have identical residence times in the reactor. Reaction medium, composed of capping buffer, S-adenosylmethionine (SAM), GTP, and uncapped RNA or 5' cap0 RNA, may be pumped into the packed bed reactor via an inlet that may be located at the bottom of the tank, and capping buffer containing the capped RNA product may be moved off via an outlet attached at the top. Inlet and outlet flow may be controlled by a pumping device in such a way that the enzymatic reaction can occur. Moreover, outlet tubes may have molecular weight cutoff filters to avoid contamination of the product by immobilized capping enzyme. One advantage of such an embodiment is that the immobilized capping enzyme does not have to be separated from the capped mRNA product by other means.

In one embodiment, the immobilized VV capping enzyme and the immobilized VV cap-specific nucleoside 2'-O-methyltransferase are part of one continuous packed bed bioreactor (FIG. 10).

In a preferred embodiment, one bioreactor module contains immobilized VV capping enzyme and another bioreactor module contains immobilized VV cap-specific nucleoside 2'-O-methyltransferase, wherein both modules are designed as continuous packed bed bioreactors and are connected to each other so that the cap0 reaction products of the immobilized VV capping enzyme form the substrates of the immobilized VV cap-specific nucleoside 2'-O-methyltransferase (FIG. 11).

Particular examples of enzyme reactors according to the present invention are provided in FIGS. 9 to 11.

Optionally, the enzyme reactor comprises
i) a capping module (10) for carrying out the capping reaction;
ii) a capture module (13) for temporarily capturing the capped RNA; and
iii) a feed module (12) for controlling the feed of components of a reaction mix into the capping module (10).

The capping module may comprise two separate modules, a first one for producing cap0 structures with the immobilized capping enzyme (10.1) and a second one for producing cap1 structures with immobilized cap-specific nucleoside 2'-O-methyltransferase (10.2). These two modules may be connected to each other so that for example the product of the first module can be transferred to the second module, optionally via the capture module. However, the enzyme reactor is configured such that the reactions in the different modules can be performed independently of each other and the reaction mixtures in the different modules are not mixed.

The feed module (12) may have a cooling device. Furthermore, all components of the feed module (12) are optionally heated to reaction temperature (heater) before they are fed into the linearization module via an inlet tube.

According to a preferred embodiment of the present invention, the enzyme reactor comprises at least one sensor unit. Data collection and analyses by the at least one sensor unit allows the control of the integrated pump system (actuator) for repeated feeds of components of the reaction mix, e.g. buffer components or nucleotides (e.g., GTP or SAM) (Pump: 14).

The capture module (13) optionally comprises a resin to capture the produced capped RNA and to separate produced capped RNA from other soluble components of the reaction mix. Optionally, the capture module (13) comprises a sensor unit to measure the concentration of the produced capped RNA, means for purifying the capped RNA and/or means for eluting the capped RNA, preferably by means of an elution buffer.

In a preferred embodiment, the enzyme reactor further comprises a re-circulation pipeline (8) for optionally returning the reaction mix (comprising capped RNA) back to the enzyme batch reactor via the feed module (12) until a desired capping degree is obtained.

In a preferred embodiment, the enzyme reactor further comprises several sensor units which may be present in the capping module (10 or 10.1/10.2), the capture module (13) or the feed module (12). The sensor units are suitable for the real-time measurement of the concentration of the concentration of nucleoside triphosphates, and/or further reaction parameters, such as pH value, reactant concentration, in- and out-flow, temperature and/or salinity, optionally, the said sensor units measure the concentration of nucleic acids by photometric analysis.

According to some embodiments, the enzyme reactor, more specifically, the sensor unit comprises at least one ion-selective electrode, preferably for measuring the concentration of one or more types of ions in a liquid comprised in at least one compartment of the enzyme reactor, wherein the ion is preferably selected from the group consisting of $H^+$, $Na^+$, $K^+$, $Mg^{2+}$, $Ca^{2+}$, $Cl^-$ and $PO_4^{3-}$.

In the context of the present invention, the term "ion-selective electrode" relates to a transducer (e.g. a sensor) that converts the activity of a specific ion dissolved in a solution into an electrical potential, wherein the electrical potential may be measured, for instance, by using a volt meter or a pH meter. In particular, the term 'ion-selective electrode' as used herein comprises a system which comprises or consists of a membrane having selective permeability, wherein the membrane typically separates two electrolytes. An ion-selective electrode as used herein typically comprises a sensing part, which preferably comprises a membrane having selective permeability and a reference electrode. The membrane is typically an ion-selective membrane, which is characterized by different permeabilities for different types of ions. Preferably, the at least one ion-selective electrode of the enzyme reactor comprises a membrane selected from the group consisting of a glass membrane, a solid state membrane, a liquid based membrane, and a compound membrane.

In preferred embodiments, the at least one ion-selective electrode comprises or consists of a system comprising a membrane, preferably a membrane as described herein, more preferably an electrochemical membrane, having different permeabilities for different types of ions, wherein the membrane, preferably a membrane as described herein, more preferably an electrochemical membrane, preferably separates two electrolytes. In one embodiment, the membrane comprises or consists of a layer of a solid electrolyte or an electrolyte solution in a solvent immiscible with water. The membrane is preferably in contact with an electrolyte solution on one or both sides. In a preferred embodiment, the ion-selective electrode comprises an internal reference electrode. Such internal reference electrode may be replaced in some embodiments, for example by a metal contact or by an insulator and a semiconductor layer. An ion-selective electrode permits highly sensitive, rapid, exact and non-destructive measurement of ion activities or ion concentrations in different media. Apart from direct measurements of ion activities or ion concentrations they can serve, in particular by using a calibration curve, for continuous monitoring of concentration changes, as elements for control of dosage of agents or as very accurate indicator electrodes in potentiometric titrations.

In preferred embodiments, the enzyme reactor comprises at least one ion-selective electrode, preferably as described herein, for measuring the concentration of one or more types of ions in at least one compartment of the enzyme reactor.

Preferably, the at least one ion-selective electrode is connected to a potentiometer, preferably a multi-channel potentiometer (for instance, a CITSens Ion Potentiometer 6-channel, high-20 resolution; C-CIT Sensors AG, Switzerland). In a preferred embodiment, the at least one ion-selective electrode is preferably a tube electrode, more preferably selected from the group consisting of a $Mg^{2+}$ selective tube electrode, a $Na^+$ selective tube electrode, a $Cl^-$ selective tube electrode, a $PO_4^{3-}$ selective tube electrode, a pH-selective tube electrode and a $Ca^{2+}$ selective tube electrode, preferably used in connection with a potentiometer. Even more preferably, the enzyme reactor (1) comprises at least one ion-selective electrode, wherein the at least one ion-selective electrode is preferably selected from the group consisting of a CITSens Ion $Mg^{2+}$ selective mini-tube electrode, a CITSens Ion $Na^+$ selective mini-tube electrode, a CITSens Ion $Cl^-$ selective mini-tube electrode, a CITSens Ion $PO_4^{3-}$ selective mini-tube electrode, a CITSens Ion pH-selective mini-tube electrode and a CITSens Ion $Ca^{2+}$ selective mini-tube electrode (all from C-CIT Sensors AG, Switzerland), preferably in connection with a potentiometer, more preferably with a multi-channel potentiometer, such as a CITSens Ion Potentiometer 6-channel, high-resolution (C-CIT Sensors AG, Switzerland).

Ion-selective electrodes have numerous advantages for practical use. For example, they do not affect the tested solution, thus allowing non-destructive measurements. Furthermore, ion-selective electrodes are mobile, suitable for direct determinations as well as titration sensors, and cost effective. The major advantage of the use of an ion-selective electrode in an enzyme reactor (e.g. a polyadenylation reactor) is the possibility to measure in situ without sample collection and in a non-destructive manner.

The ion-selective electrodes allow very specifically to monitor the capping reaction, and in particular the reaction catalyzed by the immobilized capping enzyme according to the invention.

The sensor units may further be equipped for the analysis of critical process parameters, such as pH-value, conductivity and nucleotide concentration in the reaction mix. Preferably, the sensor of the sensor units measures the nucleotide concentration, as a process parameter, by photometric analysis.

In addition to the described online measurements of the sensor units, the same measurements may be performed in separate analysis modules (as at-line controls). E.g., the progress of the capping reaction may be analyzed at-line via gel electrophoresis, photometry etc.

In another aspect, the invention provides a kit comprising an immobilized capping enzyme and/or an immobilized cap-specific nucleoside 2'-O-methyltransferase, a reaction buffer, a methyl donor (SAM) and nucleoside triphosphates. The kit may further comprise one or more of, a nucleotide mixture (optionally comprising modified nucleotides), an RNA polymerase, and an RNA in vitro transcription buffer.

In preferred embodiments of this aspect, the RNA produced according to the present invention may be used in gene therapy, (genetic) vaccination or immunotherapy.

EXAMPLES

The following Examples are merely illustrative and shall describe the present invention in a further way. These Examples shall not be construed to limit the present invention thereto.

Example 1: Example 6: Capping of Single-Stranded Synthetic 10mer RNA Using Soluble Vaccinia Virus Capping Enzyme The goal of the following experiment was to establish a capping reaction using soluble Vaccinia Virus capping enzyme on a small synthetic RNA template and to further establish a suitable quality control to analyze the capping degree of said synthetic RNA via HPLC. The established quality control was further used herein to assess the enzymatic activity of the immobilized capping enzymes and the immobilized cap-specific nucleoside 2'-O-methyltransferase according to the present invention (see Examples below).

1.1. Capping of Single Stranded 10mer RNA

To test the enzymatic efficiency of the soluble Vaccina Virus capping enzyme (herein referred to as "VVCE"), capping of 500 ng synthetic triphosphorylated 10mer RNA (ppp-GAUCGAUCGA-OH; obtained from BioSynthesis Inc.) was performed according to the manufacturer's instructions (ScriptCap capping kit, Cellscript).

1.2. Analytic Evaluation of the Capping Efficiency of Soluble VVCE Via HPLC

To analyze the capping efficiency, the enzymatically capped 10mer RNA (obtained in step 1) and uncapped 10mer RNA were diluted in 0.1 M TEAA.

HPLC analysis was performed at 60° C. using following parameters:
Eluent A: 0.1 M TEAA and Eluent B: 0.1 M TEAA+25% Acetonitril with a flow rate of 0.65 ml/min. Eluted RNA was detected with UV 260 nm.
Results:

Comparison of HPLC runs of uncapped and enzymatically capped 10mer RNA reveals strong capping efficiency of soluble VVCE. The capped RNA is released early from the HPLC column due to less free active groups (O⁻) on the capped RNA (see FIG. 13). Furthermore, the results show that the HPLC method allows for a reliable discrimination of uncapped and capped RNA, which will be necessary for the assessment of the enzymatic activity of immobilized capping enzymes (see Examples below).

Example 2: Immobilization of Vaccina Virus Capping Enzyme on Epoxy Methacrylate Beads The goal of this experiment was the stable immobilization of Vaccina Virus Capping Enzyme (VVCE). VVCE (obtained from ScriptCap m7G Capping system, cellscript) was immobilized using ECR epoxy methacrylate beads (Lifetech™ ECR8204F). To obtain a balanced distribution of immobilized enzymes per bead, bovine serum albumin (BSA) was used as a filler material to occupy excessive reactive sites on the epoxy methacrylate beads. The reaction conditions, respectively the pH, were chosen as such the formation of thioether linkages (via sulfhydryl groups present on the VVCE polypeptide chains) was promoted. The obtained VVCE-beads were tested for enzymatic activity and stability (see Example 4). A detailed description of the experiments is provided in the following.

2.1. Re-Buffering of Soluble VVCE and Epoxy Methacrylate Beads 1 ml (600 µg) soluble VVCE was concentrated to 200 µl using a 10 kDa centrifugal ultra filtration device (20° C., 2370 g) and washed 3 times with 1× immobilization buffer (100 mM $K_2HPO_4$—$KH_2PO_4$, pH 7.5, 500 mM NaCl, 1 mM EDTA) yielding a final concentration of 260 ng/µl soluble VVCE in 1× immobilization buffer.

Epoxy methacrylate beads in 1× immobilization buffer were transferred into Centricon (100 kDa MWCO) and washed three times (20 minutes, 2370 gravitational force (g)). The flow-through was discarded.

2.2. Immobilization Procedure

Re-buffered VVCE was transferred into Centricon (100 kDa MWCO) containing the re-buffered epoxy methacrylate beads and rotated (20° C., 1 h). 10 µl supernatant was taken at 0, 15 and 60 minutes to determine protein concentrations (see FIG. 14). Immobilization was stopped via centrifugation (20° C., 2370 g). The obtained VVCE-beads were washed twice with storage buffer (20 mM Tris-HCl) via centrifugation (20° C., 2370 g) and stored at 4° C.

2.3. Capping of Single Stranded 10mer RNA Using Immobilized VVCE

To assess the enzymatic activity of immobilized VVCE, capping of 500 ng of a triphosphorylated synthetic 10mer RNA was performed according to manufacturer's instructions (ScriptCap capping kit, Cellscript) using 200 µl of VVCE-beads. Capped RNA was purified from the reaction by centrifugation using Vivaspin 500 (10.000 kDa MWCO).

2.4. Analytic Evaluation of the Capping Efficiency of Immobilized VCE Via HPLC

For the analytical evaluation of the capping efficiency, the obtained RNA (from Step 3) and uncapped RNA were diluted in 0.1 M TEAA.

HPLC was performed at 60° C. using following parameters:
Eluent A: 0.1 M TEAA and Eluent B: 0.1 M TEAA+25% acetonitrile with a flow rate of 0.65 ml/min. Eluted RNA was detected with UV 260 nm. The results are shown in FIG. 15.
Results:

The analysis of the supernatant samples obtained in step 2 of the present example shows that the immobilization procedure of VVCE works. After 60 minutes of immobilization, soluble protein was not detectable in the supernatant, indicating that most of the protein was stably immobilized on the solid support (see FIG. 14)

Comparison of HPLC runs of uncapped and enzymatically capped 10mer RNA reveals strong capping efficiency of immobilized VVCE. The capped RNA is released early from the HPLC column due to less free active groups (O⁻) on the capped RNA (see FIG. 15).

Summarizing the above, the results demonstrate that covalent immobilization of VVCE works and that the covalent immobilization of VVCE does not impede the enzymatic capping activity of the enzyme. It has to be emphasized that this finding may also be transferrable to other capping enzymes. Furthermore, to obtain a more directed mode of immobilization, the use of variants of capping enzymes (e.g., D1-D12 or D12-D1 fusion proteins) or capping enzymes harboring only one cysteine residue may lead to a further improvement of the invention.

Example 3: Immobilization of Cap-Specific Nucleoside 2'-O-methyltransferase (MT) on Epoxy Methacrylate Beads The goal of this experiment was the stable immobilization of cap-specific nucleoside 2'-O-methyltransferase (MT). MT (from ScriptCap m7G Capping system, cellscript) was immobilized using ECR epoxy methacrylate beads (Lifetech™ ECR8204F). The reaction conditions, respectively the pH, were chosen as such the formation of thioether linkages (via sulfhydryl groups present on the cap-specific nucleoside 2'-O-methyltransferase) was promoted. The obtained MT-beads were tested for enzymatic activity and stability (see Example 4).

3.1. Re-Buffering of MT and Epoxy Methacrylate Beads

Re-buffering of the cap-specific nucleoside 2'-O-methyltransferase and epoxy methacrylate beads was performed as described in Example 2.

3.2. Immobilization Procedure

Immobilization of MT was performed as described in Example 2 with the difference that no BSA was used. Different samples of the supernatant were taken at 0, 15 and 60 minutes to determine protein concentrations (see FIG. 14).

Results:

The analysis of the supernatant samples obtained in step 2 of the present example shows that the immobilization procedure of MT works. After 60 minutes of immobilization, soluble protein was not detectable in the supernatant, indicating that most of the protein was stably immobilized on the solid support (see FIG. 14).

Summarizing the above, the results demonstrate that covalent immobilization of MT works. It has to be emphasized that this finding may also be transferrable to other cap-specific nucleoside 2'-O-methyltransferase.

To assess the enzymatic function of the immobilized cap-specific nucleoside 2'-O-methyltransferase, the MT-beads were tested for their enzymatic function after storage of the beads (see Example 4).

Example 4: Re-Usability Test of VVCE-Beads and MT-Beads 4.1. Capping and 2'O-methylation Reusing VCE-Beads and MT-Beads To test whether the VVCE-beads (obtained according to Example 2) and MT-beads (obtained according to Example 3) can be re-used after storage, capping of RNA reusing VCE-beads was performed as described in Example 3. To confirm enzymatic activity, the capped RNA was methylated using the MT-beads.

4.2. Analysis of Capping and 2'O-methylation Efficiency Via HPLC

Analytic evaluation of RNA capping, using immobilized capping enzyme (VVCE-beads), and evaluation of 2'-O-methylation of capped RNA, using immobilized cap-specific nucleoside 2'-O-methyltransferase (MT-beads), was analyzed via HPLC as described in Example 2. Uncapped RNA was used as a negative control. The results are shown in FIG. 16.

Results:

The results show that capping of RNA using immobilized capping enzymes was successful when using the re-used VVCE-beads (see FIG. 16). The data also implies that the enzymatic activity of the re-used beads was comparable to the activity of the beads used for the first time (cf. FIG. 15). The data shows that the VVCE-beads can be re-used for the capping of RNA which is of great advantage in large-scale mRNA production. Moreover, the re-usability of the VVCE-beads is a major advantage in the context of capping bioreactors as disclosed in the present invention.

The results show that methylation of capped RNA using immobilized cap-specific nucleoside 2'-O-methyltransferase was successful when using the MT-beads (see FIG. 16). Furthermore, to obtain a more directed mode of immobilization, variants of cap-specific nucleoside 2'-O-methyltransferase harboring only one cysteine residue may lead to a further improvement of the invention. The data also shows that the MT-beads can be re-used for the methylation of capped RNA which is of great advantage in large-scale mRNA production. Moreover, the re-usability of the MT-beads is a major advantage in the context of cap0-cap1 bioreactors as disclosed in the present invention.

Example 5: Long-Term Storage Capability of VVCE-Beads and MT-Beads 5.1. Capping and 2'O-methylation Reusing VCE-Beads and MT-Beads To test whether the VVCE-beads and MT-beads can be stored over a longer time period without impairment of enzymatic activity, VVCE-beads and MT-beads were stored for 5 days at 4° C. Then capping of RNA and 2'O-methylation of capped RNA was tested as described in Example 4.

5.2. Analytic HPLC after Long-Term Storage of VVCE-Beads and MT-Beads

After long-term storage of VVCE-beads and MT-beads and subsequent RNA capping and 2'O-methylation of capped RNA, enzymatic activity was examined via HPLC as described in Example 2. An uncapped RNA sample was used as a negative control. Results are shown in FIG. 17.

Results:

Long-term storage of VCE-beads as well as MT-beads does not impair their enzymatic activity as shown in FIG. 17 (cf. FIG. 16). This is of particular importance in the context of large-scale mRNA production. Moreover, the long-term stability is particularly important for applications in bioreactors as disclosed herein.

Example 6: Capping and 2'O-methylation of Long RNA Obtained by RNA In Vitro Transcription To test the obtained VVCE-beads and the obtained MT-beads for the enzymatic capping and capping-methylation of a large RNA, mRNA was produced using RNA in vitro transcription and subsequently capped using the immobilized enzymes. It is commonly known in the art that only capped RNA is efficiently translated into protein. Therefore, capped RNA generated with the VVCE-beads and capped RNA with an additional methylation (cap1) generated with the MT-beads was transfected into cells and translation efficiency of the encoded protein was monitored.

6.1. Linearization of P1040

For use as a template in a subsequent RNA in vitro transcription, 400 μg P1040 (encoding luciferase; see FIG. 12; SEQ ID NO: 13) was linearized using EcoRI (37° C., 160 minutes, 400 rpm). Afterwards, EcoRI was heat inactivated (65° C., 30 minutes) and DNA was precipitated. For precipitation, the sample was cooled on ice and 0.7 Vol Isopropanol was added. The sample was vortexed and centrifuged (4° C., 40 minutes, 3000 g). Then, supernatant was removed and the pelletized DNA was washed with 75% Ethanol (room temperature, 10 minutes, 3000 g). Supernatant was discarded, the DNA was dried (room temperature, 1 h) and re-suspended in water for injection (WFI) yielding a final concentration of 0.9 g/l.

6.2. In Vitro Transcription of Linearized P1040

For RNA in vitro transcription 2 μg of linearized template DNA obtained from step 1 was incubated in 80 mM HEPES, 24 mM $MgCl_2$, 2 mM spermidine, 40 mM DTT, 4 U RNAse inhibitor/μg DNA, 4 mM ATP, 4 mM CTP, 4 mM UTP, 1.45 mM GTP, 5.8 mM CAP, 100 U T7 polymerase/μg DNA, and 5 U pyrophosphatase/ml for 2 hours at 37° C. Subsequently, the plasmid DNA was digested by adding 12 μl DNAseI (1 U/μl) and 0.4 μl $CaCl_2$ (0.1 M) to the RNA in vitro transcription reaction and incubated for 1 hour at 37° C.

6.3. Capping and Methylation of In Vitro Transcribed Luciferase mRNA

50 μg of in vitro transcribed luciferase mRNA was either capped using VVCE-beads or capped using soluble VVCE and 2'O-methylated using MT-beads. The reactions were performed as described in Examples 3 and 4.

6.4. RNA Purification Using AMpureXP Beads

Capped as well as capped and 2'-O-methylated luciferase mRNA samples were mixed with 0.6 volume of AMpureXP beads. Beads were washed twice with 70% EtOH. Supernatant was discarded and beads were dried (3 minutes, RT, clean bench). Dried mRNA samples were re-suspended in 100 μl water for injection (WFI).

6.5. Transfection of P1040 mRNA Species in HeLa Cells

To control efficient translation of capped as well as capped and 2'-O-methylated luciferase mRNA, 100 μg of each mRNA species were transfected separately into $1\times10^4$ HeLa cells using Lipofectamin2000 (ThermoScientific). Transfections were performed according to manufacturer's instructions.

6.6. Luciferase Assay 6 h after transfection, HeLa cells were lysed using 5× Lysis Buffer (Promega) according to manufacturer's instructions. Subsequent luciferase assays were performed using the Beetle-Juice Luciferase assay Firefly (p·j·k) according to manufacturer's instructions. The result of the luciferase assay is shown in FIG. 18.
Results:

Capping as well as capping and 2'O-methylation luciferase mRNA obtained from RNA in vitro transcription leads to an increased luciferase expression compared to untreated mRNA control. These results show that VVCE-beads and MT-beads exhibit strong enzymatic activity. In addition, the results show that immobilized capping enzymes and immobilized cap-specific nucleoside 2'-O-methyltransferase proteins can be used to generate functional capped mRNA.

Example 7: Preparation of Uncapped RNA

In the examples the following plasmid DNA is used for digestion with the restriction endonuclease EcoRI to obtain linearized template DNA for in vitro transcription of RNA:

P1040 according to SEQ ID NO: 13 codes for the RNA PpLuc (GC)GA-A64-C30-histone stem-loop according to SEQ ID NO: 14. The corresponding plasmid map is shown in FIG. 12.

7.1. Linearization of the Plasmid to Generate a Linear DNA Template

For plasmid DNA linearization, plasmid DNA is incubated in EcoRI digestion buffer (100 mM Tris-HCl, 50 mM NaCl, 10 mM MgCl2, 0.025% Triton X-100, pH 7.5) and EcoRI restriction enzyme for 4 hours at 37° C. Following that, linearized DNA template is purified using phenol/chloroform extraction and isopropanol precipitation. After precipitation the linearized template DNA pellet is washed in ethanol and, after drying the DNA pellet, re-suspended in water for injection.

7.2 RNA In Vitro Transcription

For RNA in vitro transcription 20 μg of purified linearized template DNA are incubated in 80 mM HEPES, 24 mM MgCl$_2$, 2 mM spermidine, 40 mM DTT, 8 U RNAse inhibitor, 4 mM ATP, 4 mM CTP, 4 mM UTP, 4 mM GTP, 200 U T7 polymerase, and 10 U pyrophosphatase/μg DNA for 2 hours at 37° C.

Subsequently the plasmid DNA is removed by DNase I digestion. 12 μl DNase I (1 U/μl) and 0.4 μl CaCl2 (0.1 M) are added to the RNA in vitro transcription reaction mixture, mixed and incubated for 1 hour at 37° C.

After DNase I digestion occurred, LiCl precipitation is performed. Alternatively, a diafiltration method is used. Eventually, the RNA pellet is re-suspended in 10 ml water for injection. The RNA concentration is determined by photometry and the RNA is detected by RNA agarose gel electrophoresis and used as a substrate in the capping reactor.

Example 8: Vaccinia Virus Capping Enzyme (D1-D12 (C153V, C173A, C184S, C202A, 288C)) Immobilized on Sepharose 4B in a Continuous Packed Bed Capping Reactor 3 mg purified recombinant Vaccinia virus D12 mutant polypeptide (C153V, C173A, C184S, C202A, 288C; SEQ ID NO: 5) (codon optimization, gene synthesis sub cloning, protein expression and protein purification performed by Genscript) is transferred to 10 ml coupling buffer (0.1 M Tris-HCl pH 7.5, 0.5 M NaCl, 1 mM EDTA). EDTA is added to the buffer to remove trace amounts of heavy metal ions, which may catalyze oxidation of thiols. De-gassing of the buffer is performed to avoid oxidation of free thiol groups. The final concentration of the protein in coupling buffer is 300 μg/ml.

8.1 Coupling of Mutant D12 Polypeptide to Thiol Sepharose™ 4B HiTrap Columns (GE Healthcare)

Recombinant D12 polypeptide is coupled on HiTrap columns that have been pre-packed with 5 ml bed volumes of activated Thiol Sepharose 4B (agarose-(glutathione-2-pyridyl disulfide); GE Healthcare) corresponding to 5 μMol of activated thiol groups. The Thiol Sepharose™ 4B HiTrap column is connected to an input—and an output tank. The flow is adjusted to 5 cm/h using a peristaltic pump. Moreover, the output-tank is connected to the input-tank to optionally facilitate continuous flow in a closed continuous flow system (setup illustrated in FIG. 10).

First, the column is washed 3 times with coupling buffer, with a 10-fold excess of buffer to resin bed volume. Then, D12 polypeptide solution is used for coupling (5 ml 4B Thiol Sepharose resin corresponds to a molar ratio of enzyme to resin's thiol groups of approximately 1:10). With a flow-through rate of approximately 5 cm/h, coupling is allowed to happen for 2 hours. After coupling occurred, the column is washed three times with coupling buffer at a 10-fold excess of buffer to resin bed volume. After washing, the flow through is analyzed for trace protein using a Nano Drop 2000 at an absorbance wavelength of 280 nm. Additionally, coupling efficiency is directly measured as the release of thiopyridone (a by-product of enzyme coupling to the activated thiolated support), monitored at 343 nm. If coupling efficiency is less than desired, the flow-through is recycled from the output tank into the input tank onto the column for additional rounds to achieve the desired coupling efficiency (>50%). Next, excess reactive sites are blocked by washing the resin with 50 mM cysteine (in coupling buffer) for 30 min, followed by three additional washes with 25 ml coupling buffer/Triton-X (0.1 M Tris-HCl pH 7.5, 0.5 M NaCl, 1 mM EDTA, 0.5% Triton X-100).

8.2 On-Column Hetero-Dimerization of Immobilized Mutant D12 with Wild Type D1

3 mg purified wild-type Vaccinia virus D1 polypeptide according to SEQ ID NO: 1 (custom-order from Genscript) is transferred in 10 ml coupling buffer (0.1 M Tris-HCl pH 7.5, 0.5 M NaCl, 1 mM EDTA, de-gassed ddH$_2$O) to obtain a final concentration of 300 μg/ml. Subsequently, the polypeptide solution is added to the column. Dimerization is allowed to occur for 2 h at room temperature. After dimerization, the column is washed with 15 ml coupling buffer. The flow through is again analyzed for trace protein after washing steps using a Nano Drop (280 nm).

8.3 Capping of the RNA (Synthesis of a cap0 Structure):

The resin is equilibrated with 2× with 15 ml capping buffer (50 mM Tris-HCl, 5 mM KCl, 1 mM MgCl$_2$, pH 8, without DTT) for 10 minutes.

After flow through of the buffer, 10 ml purified uncapped luciferase RNA (SEQ ID NO: 14) (0.5 mg/ml) in capping buffer including GTP (5 Mol/L) and S-adenosylmethionine (1 Mol/L) is added and incubated for 1 h at 25° C. The final flow through contains the 5' capped RNA (cap0) which may be used for cap1 synthesis in the cap0-cap1 reactor module (see examples below).

8.4 Cleaning and Re-Use of the Capping Reactor

After capping occurred, the capping reactor is washed several times with capping buffer. Subsequently, a new uncapped RNA template solution can be loaded on the capping reactor. Alternatively, the reactor can be stored at 4° C. for several weeks.

Example 9: Vaccinia Virus Capping Polypeptides D1 (C119A, C277A, C342A, C458A, C581A, C824A, 845C)-D12 (C153V, C173A, C184S, C202A, 288C) Immobilized on Sepharose 4B in a Continuous Packed Bed Capping Reactor 3 mg purified recombinant Vaccinia virus D1 (C119A, C277A, C342A, C458A, C581A, C824A, 845C; SEQ ID NO: 7) and D12 mutant polypeptide (C153V, C173A, C184S, C202A, 288C; SEQ ID NO: 5) (codon optimization, gene synthesis sub cloning, protein expression and protein purification performed by Genscript) are transferred to capping buffer (50 mM Tris-HCl, 5 mM KCl, 1 mM $MgCl_2$, pH 8, without DTT) to allow proteins to heterodimerize. Following that, the protein solution is transferred to 10 ml coupling buffer (0.1 M Tris-HCl pH 7.5, 0.5 M NaCl, 1 mM EDTA). EDTA is added to the buffer to remove trace amounts of heavy metal ions, which may catalyze oxidation of thiols. De-gassing of the buffer is performed to avoid oxidation of free thiol groups. The final concentration of the protein in coupling buffer is 300 µg/ml.

9.1 Coupling of Mutant Capping Protein to Thiol Sepharose™ 4B HiTrap Columns (GE Healthcare)

Recombinant heterodimeric capping protein is coupled on HiTrap columns that have been pre-packed with 5 ml bed volumes of activated Thiol Sepharose m4B (agarose-(glutathione-2-pyridyl disulfide); GE Healthcare) corresponding to 5 µMol of activated thiol groups. The Thiol Sepharose™ 4B HiTrap column is connected to an input—and an output tank. The flow is adjusted to 5 cm/h using a peristaltic pump. Moreover, the output-tank is connected to the input-tank to optionally facilitate continuous flow in a closed continuous flow system (setup illustrated in FIG. 10).

First, the column is washed 3 times with coupling buffer, with a 10-fold excess of buffer to resin bed volume. Then, heterodimer solution is used for coupling (5 ml 4B Thiol Sepharose™ resin corresponds to a molar ratio of enzyme to resin's thiol groups of approximately 1:10). With a flow-through rate of approximately 5 cm/h, coupling is allowed to happen for 2 hours. After coupling occurred, the column is washed three times with coupling buffer at a 10-fold excess of buffer to resin bed volume. After washing, the flow through is analyzed for trace protein using a Nano Drop 2000 at an absorbance wavelength of 280 nm. Additionally, coupling efficiency is directly measured as the release of thiopyridone (a by-product of enzyme coupling to the activated thiolated support), monitored at 343 nm. If coupling efficiency is less than desired, the flow-through is recycled from the output tank into the input tank onto the column for additional rounds to achieve the desired coupling efficiency (>50%). Next, excess reactive sites are blocked by washing the resin with 50 mM cysteine (in coupling buffer) for 30 min, followed by three additional washes with 25 ml coupling buffer/Triton-X (0.1 M Tris-HCl pH 7.5, 0.5 M NaCl, 1 mM EDTA, 0.5% Triton X-100).

9.2 Capping of the RNA (Synthesis of a cap0 Structure):

The resin is equilibrated with 2× with 15 ml capping buffer (50 mM Tris-HCl, 5 mM KCl, 1 mM $MgCl_2$, pH 8, without DTT) for 10 minutes.

After flow through of the buffer, 10 ml purified uncapped luciferase RNA (0.5 mg/ml) in capping buffer including GTP (5 Mol/L) and S-adenosylmethionine (1 Mol/L) is added and incubated for 1 h at 25° C. The final flow through contains the 5' capped RNA (cap0) which may be used for cap1 synthesis in the cap0-cap1 reactor module (see examples below).

9.3 Cleaning and Re-Use of the Capping Reactor

After capping occurred, the capping reactor is washed several times with capping buffer. Subsequently, a new uncapped RNA template solution can be loaded on the capping reactor. Alternatively, the reactor can be stored at 4° C. for several weeks.

Example 10: Vaccinia Virus Capping Fusion Protein D1-D12 Immobilized on Sepharose 4B in a Continuous Packed Bed Capping Reactor In this example 3 mg purified recombinant Vaccinia virus fusion protein D1-D12 according to SEQ ID No. 10, wherein Cysteine residues in the D1 (C119A, C277A, C342A, C458A, C581A, C824A) and D12 elements (C153V, C173A, C184S, C202A) are substituted, and a C-terminal Cysteine residue (via a Glycine-rich linker) "GGGGGGC" is introduced (SEQ ID NO: 10) (codon optimization, gene synthesis sub cloning, protein expression and protein purification performed by Genscript) is used.

The protein is transferred to 10 ml coupling buffer (0.1 M Tris-HCl pH 7.5, 0.5 M NaCl, 1 mM EDTA). EDTA is added to the buffer to remove trace amounts of heavy metal ions, which may catalyze oxidation of thiols. De-gassing of the buffer is performed to avoid oxidation of free thiol groups. The final concentration of the protein in coupling buffer is 300 µg/ml.

10.1 Coupling of Mutant Capping Protein to Thiol Sepharose™4B HiTrap Columns (GE Healthcare)

Recombinant capping protein is coupled on HiTrap columns that have been pre-packed with 5 ml bed volumes of activated Thiol Sepharose 4B (agarose-(glutathione-2-pyridyl disulfide); GE Healthcare) corresponding to 5 µMol of activated thiol groups. The Thiol Sepharose™4B HiTrap column is connected to an input—and an output tank. The flow is adjusted to 5 cm/h using a peristaltic pump. Moreover, the output-tank is connected to the input-tank to optionally facilitate continuous flow in a closed continuous flow system (setup illustrated in FIG. 10).

First, the column is washed 3 times with coupling buffer, with a 10-fold excess of buffer to resin bed volume. Then, fusion protein solution is used for coupling (5 ml 4B Thiol Sepharose resin corresponds to a molar ratio of enzyme to resin's thiol groups of approximately 1:10). With a flow-through rate of approximately 5 cm/h, coupling is allowed to happen for 2 hours. After coupling occurred, the column is washed three times with coupling buffer at a 10-fold excess of buffer to resin bed volume. After washing, the flow through is analyzed for trace protein using a Nano Drop 2000 at an absorbance wavelength of 280 nm. Additionally, coupling efficiency is directly measured as the release of thiopyridone (a by-product of enzyme coupling to the activated thiolated support), monitored at 343 nm. If coupling efficiency is less than desired, the flow-through is recycled from the output tank into the input tank onto the column for additional rounds to achieve the desired coupling efficiency (>50%). Next, excess reactive sites are blocked by washing the resin with 50 mM cysteine (in coupling buffer) for 30 min, followed by three additional washes with 25 ml coupling buffer/Triton-X (0.1 M Tris-HCl pH 7.5, 0.5 M NaCl, 1 mM EDTA, 0.5% Triton X-100).

10.2 Capping of the RNA (Synthesis of a cap0 Structure)

The resin is equilibrated two times with 15 ml capping buffer (50 mM Tris-HCl, 5 mM KCl, 1 mM $MgCl_2$, pH 8, without DTT) for 10 minutes.

After flow through of the buffer, 10 ml purified uncapped luciferase RNA (0.5 mg/ml) in capping buffer including GTP (5 Mol/L) and S-adenosylmethionine (1 Mol/L) is added and incubated for 1 h at 25° C. The final flow through contains the 5' capped RNA (cap0).

10.3 Cleaning and Re-Use of the Capping Reactor

After capping occurred, the capping reactor is washed several times with capping buffer. Subsequently, a new uncapped RNA template solution can be loaded on the capping reactor. Alternatively, the reactor can be stored at 4° C. for several weeks.

Example 11: Vaccinia Virus Cap-Specific Nucleoside 2'-O-Methyltransferase (C178A and C272A, C-Terminal GGGGGC) Immobilized on Sepharose™4B in a Continuous Packed Bed cap0-cap1 Reactor Module In this example 3 mg purified recombinant Vaccinia virus cap-specific nucleoside 2'-O-methyltransferase whereas Cysteine residues is substituted (C178A and C272A) and a C-terminal Cysteine residue (via a Glycine-rich linker) "GGGGGGC" is introduced (SEQ ID NO: 12) (codon optimization, gene synthesis sub cloning, protein expression and protein purification performed by Genscript) is used.

The protein is transferred to 10 ml coupling buffer (0.1 M Tris-HCl pH 7.5, 0.5 M NaCl, 1 mM EDTA). EDTA is added to the buffer to remove trace amounts of heavy metal ions, which may catalyze oxidation of thiols. De-gassing of the buffer is performed to avoid oxidation of free thiol groups. The final concentration of the protein in coupling buffer is 300 µg/ml.

11.1 Coupling of Mutant 2'-O-Methyltransferase Protein to Thiol Sepharose™4B HiTrap Columns (GE Healthcare)

Recombinant cap-specific nucleoside 2'-O-methyltransferase is coupled on HiTrap columns that have been pre-packed with 5 ml bed volumes of activated Thiol Sepharose™4B (agarose-(glutathione-2-pyridyl disulfide); GE Healthcare) corresponding to 5 µMol of activated thiol groups. The Thiol Sepharose™4B HiTrap column is connected to an input—and an output tank. The flow is adjusted to 5 cm/h using a peristaltic pump. The cap0-cap1 reactor module is an element in the capping reactor, where 5' capped RNA (cap0) is pumped into the cap0-cap1 reactor module and serves as a substrate for the cap-specific nucleoside 2'-O-methyltransferase immobilized in this module (FIG. 11).

First, the column is washed 3 times with coupling buffer, with a 10-fold excess of buffer to resin bed volume. Then, the protein solution is used for coupling (5 ml 4B Thiol Sepharose resin corresponds to a molar ratio of enzyme to resin's thiol groups of approximately 1:10). With a flow-through rate of approximately 5 cm/h, coupling is allowed to happen for 2 hours. After coupling occurred, the column is washed three times with coupling buffer at a 10-fold excess of buffer to resin bed volume. After washing, the flow through is analyzed for trace protein using a Nano Drop 2000 at an absorbance wavelength of 280 nm. Additionally, coupling efficiency is directly measured as the release of thiopyridone (a by-product of enzyme coupling to the acti-vated thiolated support), monitored at 343 nm. If coupling efficiency is less than desired, the flow-through is recycled from the output tank into the input tank onto the column for additional rounds to achieve the desired coupling efficiency (>50%). Next, excess reactive sites are blocked by washing the resin with 50 mM cysteine (in coupling buffer) for 30 min, followed by three additional washes with 25 ml coupling buffer/Triton-X (0.1 M Tris-HCl pH 7.5, 0.5 M NaCl, 1 mM EDTA, 0.5% Triton X-100).

11.2 Converting of the 5'-cap0 Structure into a 5'-cap1 Structure:

Next, the resin is equilibrated with two times with 15 ml capping buffer (50 mM Tris-HCl, 5 mM KCl, 1 mM MgCl$_2$, pH 8, without DTT) for 10 minutes. After flow through of the buffer, 10 ml purified 5' capped (cap0) luciferase RNA (0.5 mg/ml) in capping buffer and S-adenosylmethionine (1 Mol/L) without GTP is added and incubated for 1 h at 25° Mol/L) without GTP is added and incubated for 1 h at 25° C. Optionally, the 5' capped (cap0) RNA is pumped directly into the cap0-cap1 reactor module, according to FIG. 11.

11.3 Cleaning and Re-Use of the Capping Reactor

After capping occurred, the capping reactor is washed several times with capping buffer. Subsequently, a new uncapped RNA template solution can be loaded on the capping reactor. Alternatively, the reactor can be stored at 4° C. for several weeks.

Embodiment List

1. Cap-specific nucleoside 2'-O-methyltransferase being immobilized onto a solid support.

2. The cap-specific nucleoside 2'-O-methyltransferase according to item 1 being immobilized onto said solid support by covalent binding.

3. The cap-specific nucleoside 2'-O-methyltransferase according to item 1 or 2 being immobilized by covalent binding to a thiol-activated solid support, haloacetyl functionalized solid support, pyridyl disulfide-functionalized solid support, epoxy-activated solid support, maleimide-activated solid support or a mixture thereof.

4. The cap-specific nucleoside 2'-O-methyltransferase according to any one of the preceding items being immobilized via at least one thiol group, and/or amine group, and/or hydroxyl group.

5. The cap-specific nucleoside 2'-O-methyltransferase according to any one of the preceding items being immobilized via a thiol group of at least one cysteine residue.

6. The cap-specific nucleoside 2'-O-methyltransferase according to any one of items 2 to 5, wherein the covalent binding is a disulfide bridge or a thioether bond.

7. The cap-specific nucleoside 2'-O-methyltransferase according to any one of the preceding items, wherein the solid support comprises a material selected from the group consisting of Sepharose™, thiopropyl-Sepharose™, Sephadex™, agarose, silica, magnetic beads, methacrylate beads and nanoparticles.

8. The cap-specific nucleoside 2'-O-methyltransferase according to any one of the preceding items, wherein the solid support is selected from the group consisting of activated thiol Sepharose™, thiopropyl-Sepharose™, thiol-activated Sephadex™, thiol-activated agarose, silica-based thiol-activated matrix, silica-based thiol-activated magnetic beads, pyridyl disulfide-functionalized nanoparticles, epoxy methacrylate beads, maleimide-activated agarose and mixtures thereof.

9. The cap-specific nucleoside 2'-O-methyltransferase according to item 1 being immobilized to an epoxy-activated solid support via a thiol group of at least one cysteine residue.

10. The cap-specific nucleoside 2'-O-methyltransferase according to item 9, wherein the epoxy-activated solid support is epoxy methacrylate beads.

11. The cap-specific nucleoside 2'-O-methyltransferase according to any one of the preceding items, wherein the wild-type cap-specific nucleoside 2'-O-methyltransferase comprises an amino acid sequence selected from the group consisting of SEQ ID NOs: 3 and 128-160 or a functional variant thereof having at least 80% sequence identity to the amino acid sequence according to any of SEQ ID NOs: 3 and 128-160.

12. The cap-specific nucleoside 2'-O-methyltransferase according to any one of the preceding items, wherein the cap-specific nucleoside 2'-O-methyltransferase comprises at least one newly introduced cysteine residue compared to the wild-type cap-specific nucleoside 2'-O-methyltransferase.

13. The cap-specific nucleoside 2'-O-methyltransferase according to item 12, wherein the newly introduced cysteine residue is attached to the C terminus of the cap-specific nucleoside 2'-O-methyltransferase, preferably via a linker.

14. The cap-specific nucleoside 2'-O-methyltransferase according to any one of the preceding items, wherein the cap-specific nucleoside 2'-O-methyltransferase comprises only one cysteine residue or is mutated to comprise only one cysteine residue.

15. The cap-specific nucleoside 2'-O-methyltransferase according to item 14, wherein the only one cysteine residue is a newly introduced cysteine residue.

16. The cap-specific nucleoside 2'-O-methyltransferase according to item 15, wherein the newly introduced cysteine residue is attached to the C terminus of the cap-specific nucleoside 2'-O-methyltransferase, preferably via a linker.

17. The cap-specific nucleoside 2'-O-methyltransferase according to any one of items 12 to 16, wherein the cap-specific nucleoside 2'-O-methyltransferase comprises the amino acid sequence according to any one of SEQ ID NOs: 11, 12 and 328-360 or a functional variant thereof having at least 80% sequence identity to the amino acid sequence according to any one of SEQ ID NOs: 11, 12 and 328-360.

18. Method for producing the cap-specific nucleoside 2'-O-methyltransferase of any one of the preceding items, comprising a step of
a) contacting said cap-specific nucleoside 2'-O-methyltransferase with a solid support under conditions suitable for immobilizing the capping enzyme to the solid support by covalent binding, affinity binding, or physical adsorption.

19. The method according to item 18, wherein step a) comprises the formation of a disulfide bridge or thioether bond.

20. The method according to item 18 or 19, wherein step a) comprises the formation of a covalent bond between a cysteine residue of the cap-specific nucleoside 2'-O-methyltransferase and a thiol group, a haloacetyl group, a pyridyl disulfide, epoxy group, or a maleimide group of the solid support.

21. The method according to any one of items 18 to 20, wherein the solid support is a thiol-activated solid support, haloacetyl functionalized solid support, pyridyl disulfide-functionalized solid support, epoxy-activated solid support, or maleimide-activated solid support.

22. The method according to item 18, wherein the solid support is an epoxy-activated solid support and the cap-specific nucleoside 2'-O-methyltransferase forms a thioether bond with the epoxy-activated solid support.

23. The method according to item 22, wherein the solid support is epoxy methacrylate beads.

24. Use of a cap-specific nucleoside 2'-O-methyltransferase being immobilized onto a solid support for producing ribonucleic acid (RNA) molecules with 5' cap1 structures.

25. The use according to item 24, wherein the cap-specific nucleoside 2'-O-methyltransferase is defined as in any one of items 1 to 17.

26. Method for producing ribonucleic acid (RNA) molecules with a cap1 structure, comprising the step of contacting RNA with a cap0 structure with a cap-specific nucleoside 2'-O-methyltransferase being immobilized to a solid support and a methyl donor under conditions suitable for forming the cap1 structure.

27. The method according to item 26, wherein the cap-specific nucleoside 2'-O-methyltransferase is defined as in any one of items 1 to 14.

28. The method according to item 26 or 27, further comprising a step of
ii) isolating the capped RNA molecules by filtration or chromatography.

29. The method according to item 28, wherein the filtration comprises ultrafiltration and/or diafiltration.

30. The method according to item 28 or 29, further comprising a step of
iii) formulating the capped RNA for administration to a human subject.

31. Enzyme reactor comprising a cap-specific nucleoside 2'-O-methyltransferase according to any one of items 1 to 17.

32. Use of the enzyme reactor according to item 26 in a method according to any one of items 26 to 30.

33. Cap-specific nucleoside 2'-O-methyltransferase comprising the amino acid sequence according to any one of SEQ ID NOs: 11, 12, 228-260 and 328-360 or a functional variant thereof having at least 80% sequence identity to the amino acid sequence according to any one of SEQ ID NOs: 11, 12, 228-260 and 328-360.

SEQUENCE LISTING (387 sequences)

SEQ ID NO: 1 - protein, 844 aa, Vaccinia virus
MDANVVSSSTIATYIDALAKNASELEQRSTAYEINNELELVFIKPPLITLTNVVNISTIQESFIRFTVTNKEGVKIRTKIPLSKVHGLDVKNVQLVDAIDNIVWEKKSLVTENRLHKECLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSNGLYCYFTHLGYIIRYPVKRIIDSEVVVFGEAVKDKNWTVYLIKLIEPVNAINDRLEESKYVESKLVDICDRIVFKSKKYEGPFTTTSEVVDMLSTYLPKQPEGVILFYSKGPKSNIDFKIKKENTIDQTANVVFRYMSSEPIIFGESSIFVEYKKFSNDKGFPKEYGSGKIVLYNGVNYLNNIYCLEYINTHNEVGIKSVVVPIKFIAEFLVNGEILKPRIDKTMKYINSEDYYGNQHNIIVEHLRDQSIKIGDIFNEDKLSDVGHQYANNDKFRLNPEVSYFTNKRTRGPLGILSNYVKTLLISMYCSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKCEGLDVEDLLSYYVVYVFSKR

SEQ ID NO: 2 - protein, 287 aa, Vaccinia virus
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYCIIKLPTLFGRGVIDTMRIYCSLFKNVRLLKCVSDSWLKDSAIMVASDVCKKNLDLFMSHVKSVTKSSSWKDVNSVQFSILNNPVDTEFINKFLEFSNRVYEALYYVHSLLYSSMTSDSKSIENKHQRRLVKLLL

SEQ ID NO: 3 - protein, 333 aa, Vaccinia virus
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTADLLSNYALQNVMISILNPVASSLKWRCPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYCNKTFPTTKAKVLFLQQSIFRFLNIPTTSTEKVSHEPIQRKISSKNSMSKNRNSKRSVRSNK

SEQ ID NO: 4 - protein, 287 aa, artificial
  variant of the D12 polypeptide
  VARIANT (153)..(153): A or S
  VARIANT (173)..(173): A or S
  VARIANT (184)..(184): A or S
  VARIANT (202)..(202): A or S
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYVIIKLPTLFGRGVIDTMRIYVSLFKNVRLLKVVSDSWLKDSAIMVASDVVKKNLDLFMSHVKSVTKSSSWKDVNSVQFSILNNPVDTEFINKFLEFSNRVYEALYYVHSLLYSSMTSDSKSIENKHQRRLVKLLL

SEQ ID NO: 5 - protein, 288 aa, artificial
  variant of D12 polypeptide
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYVIIKLPTLFGRGVIDTMRIYASLFKNVRLLKSVSDSWLKDSAIMVASDVAKKNLDLFMSHVKSVTKSSSWKDVNSVQFSILNNPVDTEFINKFLEFSNRVYEALYYVHSLLYSSMTSDSKSIENKHQRRLVKLLLC

SEQ ID NO: 6 - protein, 844 aa, artificial
  variant of D1
  VARIANT (119)..(119): A or S
  VARIANT (277)..(277): A or S
  VARIANT (342)..(342): A or S
  VARIANT (458)..(458): A or S
  VARIANT (581)..(581): A or S
  VARIANT (824)..(824): A or S
MDANVVSSSTIATYIDALAKNASELEQRSTAYEINNELELVFIKPPLITLTNVVNISTIQESFIRFTVTNKEGVKIRTKIPLSKVHGLDVKNVQLVDAIDNIVWEKKSLVTENRLHKEVLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSNGLYVYFTHLGYIIRYPVKRIIDSEVVVFGEAVKDKNWTVYLIKLIEPVNAINDRLEESKYVESKLVDIVDRIVFKSKKYEGPFTTTSEVVDMLSTYLPKQPEGVILFYSKGPKSNIDFKIKKENTIDQTANVVFRYMSSEPIIFGESSIFVEYKKFSNDKGFPKEYGSGKIVLYNGVNYLNNIYVLEYINTHNEVGIKSVVVPIKFIAEFLVNGEILKPRIDKTMKYINSEDYYGNQHNIIVEHLRDQSIKIGDIFNEDKLSDVGHQYANNDKFRLNPEVSYFTNKRTRGPLGILSNYVKTLLISMYVSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKVEGLDVEDLLSYYVVYVFSKR

SEQ ID NO: 7 - protein, 845 aa, artificial
  variant of D1
MDANVVSSSTIATYIDALAKNASELEQRSTAYEINNELELVFIKPPLITLTNVVNISTIQESFIRFTVTNKEGVKIRTKIPLSKVHGLDVKNVQLVDAIDNIVWEKKSLVTENRLHKEALLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSNGLYAYFTHLGYIIRYPVKRIIDSEVVVFGEAVKDKNWTVYLIKLIEPVNAINDRLEESKYVESKLVDIADRIVFKSKKYEGPFTTTSEVVDMLSTYLPKQPEGVILFYSKGPKSNIDFKIKKENTIDQTANVVFRYMSSEPIIFGESSIFVEYKKFSNDKGFPKEYGSGKIVLYNGVNYLNNIYALEYINTHNEVGIKSVVVPIKFIAEFLVNGEILKPRIDKTMKYINSEDYYGNQHNIIVEHLRDQSIKIGDIFNEDKLSDVGHQYANNDKFRLNPEVSYFTNKRTRGPLGILSNYVKTLLISMYASKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKAEGLDVEDLLSYYVVYVFSKRC

SEQ ID NO: 8 - protein, 1146 aa, artificial
  D1-D12 fusion protein
  VARIANT (119)..(119): V, A or S
  VARIANT (277)..(277): V, A or S
  VARIANT (342)..(342): V, A or S
  VARIANT (458)..(458): V, A or S
  VARIANT (581)..(581): V, A or S
  VARIANT (824)..(824): V, A or S
  VARIANT (1012)..(1012): V, A or S
  VARIANT (1032)..(1032): V, A or S
  VARIANT (1043)..(1043): V, A or S
  VARIANT (1061)..(1061): V, A or S
MDANVVSSSTIATYIDALAKNASELEQRSTAYEINNELELVFIKPPLITLTNVVNISTIQESFIRFTVTNKEGVKIRTKIPLSKVHGLDVKNVQLVDAIDNIVWEKKSLVTENRLHKECLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSNGLYCYFTHLGYIIRYPVKRIIDSEVVVFGEAVKDKNWTVYLIKLIEPVNAINDRLEESKYVESKLVDICDRIVFKSKKYEGPFTTTSEVVDMLSTYLPKQPEGVILFYSKGPKSNIDFKIKKENTIDQTANVVFRYMSSEPIIFGESSIFVEYKKFSNDKGFPKEYGSGKIVLYNGVNYLNNIYCLEYINTHNEVGIKSVVVPIKFIAEFLVNGEILKPRIDKTMKYINSEDYYGNQHNIIVEHLRDQSIKIGDIFNEDKLSDVGHQYANNDKFRLNPEVSYFTNKRTRGPLGILSNYVKTLLISMYCSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKCEGLDVEDLLSYYVVYVFSKRGGGGSGGGGSGGGGSMDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYCIIKLPTLFGRGVIDTMRIYCSLFKNVRLLKCVSDSWLKDSAIMVASDVCKKNLDLFMSHVKSVTKSSSWKDVNSVQFSILNNPVDTEFINKFLEFSNRVYEALYYVHSLLYSSMTSDSKSIENKHQRRLVKLLL

SEQ ID NO: 9 - protein, 1146 aa, artificial
  fusion protein of D12 and D1
  VARIANT (153)..(153): V, A or S
  VARIANT (173)..(173): V, A or S
  VARIANT (184)..(184): V, A or S
  VARIANT (202)..(202): V, A or S
  VARIANT (421)..(421): V, A or S
  VARIANT (579)..(579): V, A or S
  VARIANT (644)..(644): V, A or S
  VARIANT (760)..(760): V, A or S
  VARIANT (883)..(883): V, A or S
  VARIANT (1126)..(1126): V, A or S
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYCIIKLPTLFGRGVIDTMRIYCSLFKNVRLLKCVSDSWLKDSAIMVASDVCKKNLDLFMSHVKSVTKSSSWKDVNSVQFSILNNPVDTEFINKFLEFSNRVYEALYYVHSLLYSSMTSDSKSIENKHQRRLVKLLLGGGGSGGGGSGGGGSMDANVVSSSTIATYIDALAKNASELEQRSTAYEINNELELVFIKPPLITLTNVVNISTIQESFIRFTVTNKEGVKIRTKIPLSKVHGLDVKNVQLVDAIDNIVWEKKSLVTENRLHKECLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSNGLYCYFTHLGYIIRYPVKRIIDSEVVVFGEAVKDKNWTVYLIKLIEPVNAINDRLEESKYVESKLVDICDRIVFKSKKYEGPFTTTSEVVDMLSTYLPKQPEGVILFYSKGPKSNIDFKIKKENTIDQTANVVFRYMSSEPIIFGESSIFVEYKKFSNDKGFPKEYGSGKIVLYNGVNYLNNIYCLEYINTHNEVGIKSVVVPIKFIAEFLVNGEILKPRIDKTMKYINSEDYYGNQHNIIVEHLRDQSIKIGDIFNEDKLSDVGHQYANNDKFRLNPEVSYFTNKRTRGPLGILSNYVKTLLISMYCSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKCEGLDVEDLLSYYVVYVFSKR

SEQ ID NO: 10 - protein, 1153 aa, artificial
  D1-D12 fusion protein
MDANVVSSSTIATYIDALAKNASELEQRSTAYEINNELELVFIKPPLITLTNVVNISTIQESFIRFTVTNKEGVKIRTKIPLSKVHGLDVKNVQLVDAIDNIVWEKKSLVTENRLHKEALLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSNGLYAYFTHLGYIIRYPVKRIIDSEVVVFGEAVKDKNWTVYLIKLIEPVNAINDRLEESKYVESKLVDIADRIVFKSKKYEGPFTTTSEVVDMLSTYLPKQPEGVILFYSKGPKSNIDFKIKKENTIDQTANVVFRYMSSEPIIFGESSIFVEYKKFSNDKGFPKEYGSGKIVLYNGVNYLNNIYALEYINTHNEVGIKSVVVPIKFIAEFLVNGEILKPRIDKTMKYINSEDYYGNQHNIIVEHLRDQSIKIGDIFNEDKLSDVGHQYANNDKFRLNPEVSYFTNKRTRGPLGILSNYVKTLLISMYASKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKAEGLDVEDLLSYYVVYVFSKRGGGGSGGGGSGGGGSMDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYVIIKLPTLFGRGVIDTMRIYASLFKNVRLLKSVSDSWLKDSAIMVASDVAKKNLDLFMSHVKSVTKSSSWKDVNSVQFSILNNPVDTEFINKFLEFSNRVYEALYYVHSLLYSSMTSDSKSIENKHQRRLVKLLLGGGGGGC

SEQ ID NO: 11 - protein, 333 aa, artificial
  variant of cap-specific nucleoside 2'-methyltransferase
  VARIANT (178)..(178): A or S
  VARIANT (272)..(272): A or S
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTADLLSNYALQNVMISILNPVASSLKWRVPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYVNKTFPTTKAKVLFLQQSIFRFLNIPTTSTEKVSHEPIQRKISSKNSMSKNRNSKRSVRSNK

SEQ ID NO: 12 - protein, 340 aa, artificial
  variant of cap-specific nucleoside 2'-O-methyltransferase
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTADLLSNYALQNVMISILNPVASSLKWRAPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYANKTFPTTKAKVLFLQQSIFRFLNIPTTSTEKVSHEPIQRKISSKNSMSKNRNSKRSVRSNKGGGGGGC

SEQ ID NO: 13 - DNA, 3907 bp, artificial
  plasmid P1040
cagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaatacgactcactatagggagaaagcttaccatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaattcggatactctagacatatgcttaag

SEQ ID NO: 14 - RNA, 1870 nt, artificial
  RNA transcript from plasmid P1040
gggagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 15 - protein, 27 aa, Artificial sequence
  Linker element with Cys
SGGGSGGGGSGGGGSGGGGSGGGSLQC

SEQ ID NO: 16 - protein, 13 aa, Artificial sequence
  Linker element with Cys
AEAAAKEAAAKAC

SEQ ID NO: 17 - protein, 47 aa, Artificial sequence
  Linker element with Cys
AEAAAKEAAAKEAAAKEAAAKALEAEAAAKEAAAKEAAAKEAAAKAC

SEQ ID NO: 18 - protein, 6 aa, Artificial sequence
  Linker element with Cys
EAAAKC

SEQ ID NO: 19 - protein, 11 aa, Artificial sequence
  Linker element with Cys
EAAAKEAAAKC

SEQ ID NO: 20 - protein, 16 aa, Artificial sequence
  Linker element with Cys
EAAAKEAAAKEAAAKC

SEQ ID NO: 21 - protein, 5 aa, Artificial sequence
  Linker element with Cys
GGGGC

SEQ ID NO: 22 - protein, 6 aa, Artificial sequence
  Linker element with Cys
GGGGGC

SEQ ID NO: 23 - protein, 7 aa, Artificial sequence
  Linker element with Cys
GGGGGGC

SEQ ID NO: 24 - protein, 9 aa, Artificial sequence
  Linker element with Cys
GGGGGGGGC

SEQ ID NO: 25 - protein, 6 aa, Artificial sequence
  Linker element with Cys
GGGGSC

SEQ ID NO: 26 - protein, 7 aa, Artificial sequence
  Linker element with Cys
GGGGSGC

SEQ ID NO: 27 - protein, 10 aa, Artificial sequence
  Linker element with Cys
GGGGSGGGGC

SEQ ID NO: 28 - protein, 11 aa, Artificial sequence
  Linker element with Cys
GGGGSGGGGSC

SEQ ID NO: 29 - protein, 11 aa, Artificial sequence
  Linker element with Cys
GGGGSGGGGSC

SEQ ID NO: 30 - protein, 16 aa, Artificial sequence
  Linker element with Cys
GGGGSGGGGSGGGGSC

SEQ ID NO: 31 - protein, 21 aa, Artificial sequence
  Linker element with Cys
GGGGSGGGGSGGGGSGGGGSC

SEQ ID NO: 32 - protein, 17 aa, Artificial sequence
  Linker element with Cys
GGGSGGGGSGGGGSGGC

SEQ ID NO: 33 - protein, 16 aa, Artificial sequence
  Linker element with Cys
GGSGGGGSGGGGSGGC

SEQ ID NO: 34 - protein, 5 aa, Artificial sequence
  Linker element with Cys
GSGSC

SEQ ID NO: 35 - protein, 22 aa, Artificial sequence
  Linker element with Cys
GSGGGGSAWSHPQFEKGGGGSC

SEQ ID NO: 36 - protein, 6 aa, Artificial sequence
  Linker element with Cys
PAPAPC

SEQ ID NO: 37 - protein, 12 aa, Artificial sequence
  Linker element with Cys
PPPGSRHDKIHC

SEQ ID NO: 38 - protein, 5 aa, Artificial sequence
  Linker element with Cys
SGGGC

SEQ ID NO: 39 - protein, 5 aa, Artificial sequence
  Linker element with Cys
GSGSC

SEQ ID NO: 40 - protein, 17 aa, Artificial sequence
  Purification tag
EWLKAFYEKVLEKLKEL

SEQ ID NO: 41 - protein, 15 aa, Artificial sequence
  Purification tag
GLNDIFEAQKIEWHE

SEQ ID NO: 42 - protein, 26 aa, Artificial sequence
  Purification tag
KRRWKKNFIAVSAANRFKKISSSGAL

SEQ ID NO: 43 - protein, 13 aa, Artificial sequence
  Purification tag
GAPVPYPDPLEPR

SEQ ID NO: 44 - protein, 16 aa, Artificial sequence
  Purification tag
LELELKLKLELELKLK

SEQ ID NO: 45 - protein, 8 aa, Artificial sequence
  Purification tag
DYKDDDDK

SEQ ID NO: 46 - protein, 6 aa, Artificial sequence
  Purification tag
EEEEEE

SEQ ID NO: 47 - protein, 9 aa, Artificial sequence
  Purification tag
YPYDVPDYA

SEQ ID NO: 48 - protein, 6 aa, Artificial sequence
  Purification tag
HHHHHH

SEQ ID NO: 49 - protein, 16 aa, Artificial sequence
  Purification tag
TDKDMTITFTNKKDAE

SEQ ID NO: 50 - protein, 10 aa, Artificial sequence
  Purification tag
EQKLISEEDL

SEQ ID NO: 51 - protein, 15 aa, Artificial sequence
  Purification tag
KETAAAKFERQHMDS

SEQ ID NO: 52 - protein, 38 aa, Artificial sequence
  Purification tag
MDEKTTGWRGGHVVEGLAGELEQLRARLEHHPQGQREP

SEQ ID NO: 53 - protein, 13 aa, Artificial sequence
  Purification tag
AHIVMVDAYKPTK

SEQ ID NO: 54 - protein, 13 aa, Artificial sequence
  Purification tag
SLAELLNAGLGGS

SEQ ID NO: 55 - protein, 8 aa, Artificial sequence
  Purification tag
TQDPSRVG

SEQ ID NO: 56 - protein, 8 aa, Artificial sequence
  Purification tag
WSHPQFEK

SEQ ID NO: 57 - protein, 11 aa, Artificial sequence
  Purification tag
MASMTGGQQMG

SEQ ID NO: 58 - protein, 14 aa, Artificial sequence
  Purification tag
GKPIPNPLLGLDST

SEQ ID NO: 59 - protein, 11 aa, Artificial sequence
  Purification tag
YTDIEMNRLGK

SEQ ID NO: 60 - protein, 8 aa, Artificial sequence
  Purification tag
DLYDDDDK

SEQ ID NO: 61 - protein, 845 aa, Monkeypox virus
MDANIVSSSTIATYIDALAKNASELEQRSTAYEINNELELVFIKPPLITLTNVVNISTIQESFIRFTVTNKEGIKIRTKIPLSKVHGLDVKNVQLVDAIDNIVWEKKSLVTENRLHKECLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSKGLYCYFTHLGYIIRYPVKRTIDSEVVVFGEAVKDKNWTVYLIKLIEPVNAISDRLEESKYVESKLVDICDRIVFKSKKYEGPFTTTSEVVDMLSTYLPKQPEGVILFYSKGPKSNIDFKIKKENTIDQTANVVFRYMSSEPIIFGESSIFIEYKKFTNDKGFPKEYGSGKIVLYNGVNYLNNIYCLEYINTHNEVGIKSVVVPIKFIAEFLVNGEILKPRIDKTMKYINSEDYYGNQHNIIVEHLRDQSIKIGDVFNEDKLSDIGHQYAANNDKFRLNPEVSYFTNKRTRGPLGILSNYVKTLLISMYCSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKCEGLDVEDLLSYYVVYVFSKR

SEQ ID NO: 62 - protein, 844 aa, Taterapox virus
MDANVISSSTIATYIDALAKNASELEQGSTAYEINNELELVFIKPPLITLTNVVNISTIQESFIRFTVTNKEGVKIRTKIPLSKVHGLDVKNVQLVDAIDNIVWEKKSLVTENRLHKECLLRLSTEERHIFLDYKKYGSSIRLELVNLIQAKTKNFTIDFKLKYFLGSGAQSKSSLLHAINHPKSRPNTSLEIEFTPRNNETVPYDELIKELTTLSRHIFMASPENVILSPPINAPINTFMLPKQDIVGLDLENLYAVTKTDGIPITIRVTSKGLYCYFTHLGYIIRYPVKRIIDSEVVVFGEAVKDKNWTVYLIKLIEPVNAISDRLEESKYVESKLVDICDRIVFKSKKYEGPFTTTSEVVDMLSTYLPKQPEGVILFYSKGPKSNIDFKIKKENTIDQTANVVFRYMSSEPIIFGESSIFIEYKKFTNDKGFPKEYGSGKIVLYNGVNYLNNIYCLEYINTHNEVGIKSVVVPIKFIAEFLVNGEILKPRIDKTMKYINSEDYYGNQHNVIVEHLRDQSIKIGDVFNEDKLSDVGHQYANNDKFRLNPEVSYFTNKRTRGPLGILSNYVKTLLISMYCSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKCEGLDVEDLLSYYVVYVFSKR

SEQ ID NO: 63 - protein, 844 aa, Camelpox virus [sequence omitted]

SEQ ID NO: 64 - protein, 844 aa, Cowpox virus
MDANVVSSSTIATYIDALAKNASELEQGSTAYEINNELELVFIKPPLITLTNVVNISTIQESFIRFTVTNKEGVKIRTKIPLSKVHGLDVKNVQLVDAIDNIVWEKKSLVTENRLHKECLLRLSTEERHIFLDYKKYGSSIRLELVNLIQAKTKNFTIDFKLKYFLGSGAQSKSSLLHAINHPKSRPNTSLEIEFTPRDNEKVPYDELIKELTTLSRHIFMASPENVILSPPINPPIKTFMLPKQDIVGLDLENLYAVTKTDGIPITIRVTSKGLYCYFTHLGYIIRYPVKRIIDSEVVVFGEAVKDKNWTVYLIKLIEPVNAISDRLEESKYVESKLVDICDRIVFKSKKYEGPFTTTSEVVDMLSTYLPKQPEGVILFYSKGPKSNIDFKIKKENTIDQTANVVFRYMSSEPIIFGESSIFIEYKKFTNDKGFPKEYGSGKIVLYNGVNYLNNIYCLEYINTHNEVGIKSVVVPIKFIAEFLVNGEILKPRIDKTMKYINSEDYYGNQHNVIVEHLRDQSIKIGDVFNEDKLSDVGHQYANNDKFRLNPEVSYFTNKRTRGPLGILSNYVKTLLISMYCSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRILVYNPSTMSTPMTEYIIKKNDIVRVFNEYGFVLVDNIDFATIIERSKKFINGASTMEDRPSTRNFFELNRGAIKCEGLDVEDLLSYYVVYVFSKR

SEQ ID NO: 65 - protein, 843 aa, Ectromelia virus
MDANIVSSSTIATYIDALAKNASELEQRSTAYEINNELELVFIKPPLITLTNVVNISTIQESFIRFTVTNKEGVKIRTKIPLSKVHGLDVKNVQLVDAIDNIVWEKKSLVTENRLHKECLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSKGLYCYFTHLGYIIRYPVKRIIDSDVVVFGEAVKDKNWTVYLIKLIEPNAIGDRLEESKYVESKLVDICDRIVFKSKKYEGPFTTTSEVVDMLSTYLPKQPEGVILFYSKGPKSNIDFKIKKENTIDQTTNVVFRYMSSEPIIFGESSIFIEYKKFTNDKGFPKEYGSGKIVLYNGVNYLNNIYCLEYINTHNEVGIKSVVVPIKFIAEFLVNGEILKPRIDKTMKYINSEDYYGNQHNIIVEHLRDQSIKIGDVFNEDKLSDVGHQYANNDKFRLNPEVSYFTNKRTRGPLGILSNYVKTLLISMYCSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRILVYNPSTMSTPMTEYIIKKNDIVRVFNEYGFVLVDNIDFATIIERSKKFINGASTMEDRPSTRNFFELNRGAIKCEGLDVEDLLSYYVVYVFSKR

SEQ ID NO: 66 - protein, 844 aa, Variola virus
MDANVVSSSTIATYIDALAKNASELEQGSTAYEINNELELVFIKPPLITLTNVVNISTIQESFIRFTVTNKEGVKIRTKIPLSKVHGLDVKNVQLVDAIDNIVWEKKSLVTENRLHKACLLRLSTEERHIFLDYKKYGSSIRLELVNLIQAKTKNFTIDFKLKYFLGSGAQSKSSLLHAINHPKSRPNTSLEIEFTPRDNETVPYDELIKELTTFSRHIFMASPENVILSPPINAPIKTFMLPKQDIVGMDLENLYAVTKTDGIPITIRVTSKGLYCYFTHLGYIIRYPVKRIIDSEVVVFGEAVKDKNWTVYLIKLIEPVNAISDRLEESKYVESKLVDICDRIVFKSKKYEGPFTTTSEVVDMLSTYLPKQPEGVILFYSKGPKSNIDFKIKKENTIDQTVNVVFRYMSSEPIIFGESSIFIEYKKFTNDKGFPKEYGSGKIVLYNGVNYLNNIYCLEYINTHNEVGIKSVVVPIKFIAEFLVNGEILKPRIDKTMKYINSEDYYGNQHNVIVEHLRDQSIKIGDVFNEDKLSDVGHQYANNDKFRLNPEVSYFTNKRTRGPLGILSNYVKTLLISMYCSKTFLDDSNKRKVLAIDFENGADLEKYFYGEIALLVATDPDADAIARGNERYNKLNSGIKTKYYKFDYIQETIRSNTFVSSVREVFYFGKFNIIDWQFAIHYSFHPRHYATIMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKCEGLDVEDLLSYYVVYVFSKR

SEQ ID NO: 67 - protein, 842 aa, Raccoonpox virus
MDAKVATSSTIATYIESLAKKSSELDNHSTAYEINNELELVFIKPPLIALTNVVSISTIQESFIRFTVTNREGVKIRTKIPLSKVHGLDVKNVQLVEAIDNIVWEKKTLVTETRLHKECLLRLSTEERHIFLDYKKYGSSIRLELVNLIQAKTKNFTIDFKLKYFLGSGAQSKSSLLHAINHPKSRPNTSLEIEFTPREDEKVPYDELIKELTTVTRHIFMASPENVILSPPISSPIKTFMLPKQDIVGLDLENLYAVTKTDGVPVTIRITSKGLYCYFTHLGYIIKYPVKRAIDTDVVVFGEAIKDKNWTVYLIKLIEPVIDDRLEESNYVDSKLVGICDRVVFKSKKYEGPFTTSSEVVDMLSTYLPKQPEGVILFYSKGSKSNVDFKIKNENTVDQAVNIVFRYMSSEPIIFGESSIFVEYKRFSNDKGFPKEYGSGKIILYNGVDYLNNIYCLTFANTHDDVGIKSIVVPIKFIAEFQVNGEILKPRIDKTMKYINSEDYYGNQHNVVVEHLRDQSIKIGNVFNEDKLSDIGHQYANNDKFRLNPEVSYFTNKRTRGPLGILSNYVKTLLISMYCSKTFLDDSNKRKVLAIDFGNGADLEKYFYGEIALLVATDPDADAIARGNERYNKLNSGIKTKYYKFDYIQETIRSETFVSSVREVFYFGKFNIIDWQFAIHYSFHPRHYATVMNNLSELTASGGKVLITTMDGDKLSKLTDKKTFIIHKNLPSSENYMSVEKIADDRILVYNPSTMSTPMTEYIIKKNDIVRVFNEYGFVLVDNVDFATIIERSKKFINGASKMEDRPSTRNFFELNRGAIKCEGLDVDDLLSYYVVYVFSKR

SEQ ID NO: 68 - protein, 839 aa, Yoka poxvirus
MDDKLLTSSIARYIEDLAKHSTELKNQSATYDVNNELELIFTNPPLITLTNVFNISTLQESFIRFTVTNKDGVKIRTKIPLSKVHGLDIKNSQLVDVIENIVWEKKTLINEIVYNKEVILRLSTEEKYIFLDYKKYGSSIKLELVNLIQSRTKNFIIDFKIKYFLGSGAQSKCSLLHSINHPKSKPNMSLEIEFISMDNKNVQYDKLLNELTTISRNIFMASPENVYLSPIIKIPVNTFMLHKQDIPALELENLYAVSKTDGIPVTVKLKSTGIYCYFGHIGYIIRYPIKKNLDTDIILFGEAIKDKNQWIIYLIKLLEPVIHDRLDERNYIESRLDDVCDRIIFKVKKYEGPFTTSSEIIDMLSNYLPKQNEGVILFYSKGNKNDYKIKKENTVDQMVNIVFRYMSSEPIIFGDNSIFIEYKKFSSDKGFPKENGSGKIIIYSDVNYLNNIYCIEFKNIYLDAGLKSVVVPIKFIAEFSTNGDIIKPRIGKTMRYINEEYYGNPYNVVVEHLRDQKISVNDIFNEDKLSEIGQQYVTNDKFRLNPEVSYFTNKRTRGPLGILSNYVKTLLISMYCSKTFLDNSNKRKVLAIDFGNGADLEKYFYGEIALLVATDPDADAISRGNDRYNKLNSGIKTKYYKFDYIKETIRSETYISSIREVFYFGKFDIIDWQFAIHYSFHPRHYSTVMRNLSELTASGGKVLITTMDGDKLSLLTSKKTFIIHKNLPDSENYMAIEKIADDRIMVYNPSTMSTPMTEYIIKKNDITRVFNEYGFVLIDNVDFATIINRSKKFINGVSKLEERPSTKNFFELNRGAIKCDGIDVDDLLSYYVVYVFSKR

SEQ ID NO: 69 - protein, 840 aa, Swinepox virus
MDDTFLTTSVYNYIYSLLDIYNDVPQPVHLDDVNHEVEMIFTNPSIVTLSNLINISSTQESYILFTLTRKDEHTKIRTKIPMSKIHGIDIKNIQLVNCIDNIIWEKKIRVKENIIDDWCIVQYSTEEKYIFLDYKKFTSSIKLELVNLIQARIKNIVIDFKIKYFLGSGAQSKSSLLHVLNHPKSKPKTSLEIEIVTRDIKIDTSVLSNEIHTICKILFMSDTKNIYLYSRFKNPIKTHMLKKQDITSIDLENLYITTKTDGVGVLVKINKNGIYCYFQHLMYTIRYTLIKVLDNDVTIYGEAIKQNNVWNIYLIKMIQPVLVDRFNERDYVVSYLNNICDRIVFKVKKYEGPFNTHSEIIDTLSTYLPLQNEGVILFYSKGSKSNIDYKIKHDNTTDNMINIIYRYMSSEPVIFGENSTFIEYKKFSDDKGFPKENGTGKLILSTDVKYLNNIYCIEFNNIYNDIGIKKVILPIKCICEFSITGEFIKPRIDKTMKYLYEEYYGNQYHVVVDHIRDQRIHINDIFDENKLSDIGKDYANDKYRLNPEISYFTNKRVRGPLGILSNYIKTLLISLYCSKTFLDNSNKRKVLAIDFGNGADLEKYFFGEVALLVATDPDKDAIRRCMERYNKLNSGIKSKYYKFDYIRETIRSETYVSNIREVFFFGKFDIIDWQFAIHYSFHPKHYATIMNNLSELTASGGKILITTMDGDKLSMLTDKKTFIIHKNLPTTENYMSIEKISDEQILVYNPSSMSKPMEEYIVKKYDIVRIFSEYGFVLIDYINFDTVIDRSKHFINNVSKMEERQSTKNFFELNRVALKYDGLDIDELLKYYVVYVFSKR

SEQ ID NO: 70 - protein, 840 aa, Yaba monkey tumor virus
MDDNNLKLSLSDYINKLICVFKTIKYPLPTEDVNNEVELVFIRPPLITLGNVLNISSVQESFIMFTVGNKEKKEKIRTNVPLSKVHGLDIKNVQLVESVNNIIWEKKTLLSEYKVNDNCLIRHSIEEKHVFLDYKKYISSIKLELVNLIQAKIKNVKVDFKLKYFLGSGAQAKSSLLHVLNHPRSKPSPSLEFEIVNTDININENELFNELHALFRSIFMNLPENVFLVPNFKNPLKTYMLKKQDISGISLDNLYATTKTDGIGAIVKIKQNKIYCHFSHINYCIKYLANRTMENEIVIYGEALKYNGKWNIYLIKLINPNLENRIMEKDFVDEELKGISDKIIFKVKKYEGPFSSHSEIIDLLTFYLPMQKEGVILFYTEGKNSSFDYKIKNDNTTDHMVNLVYRYMSSEPVIFGESNTFVEFKKFSDEKGFPKDFGTGKIILTESVKYLNNIYCLEFSNVYDDVGIKNVVVPVKFISEFSSKGNIIKPRIDKTMKYMYSDYYGNQHNVVLDHVMDQNIKIEDIFNEEKLSNIGKIYANDKYRLNPETSYFTNKRTRGPLGILSNYVKTLLISLYCSKTFLDNPNKKKVLAVDFGNGADLEKYFYGEISLLVATDPDFKAIERCNERYTKLNSGIKSKYYKFNYIQETIRSNSYVSSVREVFFFGKFDIIDWQFAIHYSFHKKHYSTIMKNLSELTASGGKVLITTMDGDKLHDLKDKKTFIIHKSLPSSENYMSVEKINTEQVLVYNPSSMSKPMEEYIVRKTDIIRVFSEYGFELIDNVDFSTIINRSKKFINCVSKMEERQSTKNFFELNRDALKFNSLDVEELLSYYVVYVFSKR

SEQ ID NO: 71 - protein, 843 aa, Deerpox virus
MDDKIFDKSLNDYINELIGVYESIPKPKSLDDINHEVEIVFIQPPLITLNNVLNISSKQESYILFSLTNKEDRVKIRSYLPMSKVYGLDLKNIQLVDSIDNIIWEKKTLITEHIVDKHCMVRYSTEEKHIFLDYRKYISAIRLELVNLIQLKIKNILIDFKIKYFLGSGAQAKSSLLHVLNHPKSKPNVSLEFEIISGNDYKIDKDIIFNEISTLFRNIFMGNPKNIFMTPEQKNPIKTRMIKKQDITGLELDNLYITTKTDGVGSLIKINKNGIFCYFSHLNYSIRYNLLKPIDKQIVLYGEALKHGKMWNIFLIKLIEPILDDRIKEKDFINDELDNVCDRLEFKVKKYEGPFTTHSEIVDLLSSYLPIQSEGAILFYSKGNKSNIDYKIKNDNTTDHMANIIYRYMSSEPVIFGENQTFIEYKKFSDDKGFPKEFGNGKIVLSEKIRYLNNIYCITFNDLYKDVGLHTVTVPIKFIAEFTTNGEFIKPRLDKTMKYFYKNYYGNQYNVVLEHLHDQHIKINDIFDENKLSNLGEEYAKDKDKNRLNPETSYFTNKRTRGPLGILSNYIKTLLISLYCSKTFLDNTNKRKVLAIDFGNGADLEKYFYGEISLLVASDPDQDAINRCIERYNKLNSGIKSKYYKFDYIKETIRSEKYVSNIREVFFFGKFDIVDWQFAIHYSFHPKHYSTVMKNLAELTASGGKVLITTMDGDKLSQLTDKKTFIIHKNLPNSENYMSVEKLNDEKILVYNPSSMSKPMEEYIIRRSDIIRIFSEYGFVLIDYVHFDTVIDRSKKFINCVSKMEERQSTKNFFELNRDALKYEKIDIESLLQYYVVYVFSKR

SEQ ID NO: 72 - protein, 835 aa, Myxoma virus
MDESKKRGTDYIEELIRVYEDVPNPVQTDDINHEVELTFIHPPIIALSTLIHVATSQESYILFTVTNKGVKIRNRINLSKIHGLDLKNIQLVDSIDNIIWEKKTLVKEHKVDPAAVVKYSTEEKYIFLDYKKYLSSIKLELVNVVQAKVKHVTVDFKFKYFLGSGAQAKSSLLHVLNHPKSKPNPSLEFEIVTTDEKIDSVSLRKELVALFKLVFMTSPDNIILDGILKPPVQTVMLKKNDLPGIDLTNLYVTTKTDGVGVLITVTNKGIYCFFTHLQYTIRYDTTFKSDNPVTLYGEAIKQNNVWHVYLIKLMTPKLSDRFKEKDYVEEHLKDICDRMIFKVKKYEGPFESHSEIIDLLTSYLPSQPEGVVLFYSDQRNQPDYKIKLDNTTDHMVNIIYRYMSSEPVIFGENSTFLEYKKFSDDKGFPKDYGTGKLALTDNVRYLNNIYCMEFANAYEDVGIKNVVVPIKFISEFSATGEFIKPRIDKTFRYLYMEYYGNPYQVVVTHIRDQSIKIGDVFDEDRLSDVGQHYANDKYRLNPDVSYFTNKRTRGPLGILSNYVKTLLISLYCSKTFLDNSNKRKVLAIDFGNGADLEKYFYGEISSLVATDPDKEAITRCIERYNSLNSGIKSKYYKFDYIQETIRSTTYVSSVREVFFFGKFDLVDWQFAIHYSFHPKHYTTVMNNLAELTASGGKVLITTMDGDLLSQLTDKKTFVIHKNLPSSENYMSVEKIHEDQILVYNPSSMSRPMQEYIIKRANLTKIFSEYGFELIDCVHFDTVVERSKRFITGVSKMEERKSTKNFFELNREALKYEGTDIGDLLRYYIVYVFSKR

SEQ ID NO: 73 - protein, 840 aa, Yaba-like disease virus
MDDDNLKLSLLDYIKKLICVFKTIKNPLPTEDVNNEVELIFIQPPLITLGNLLNISSVQESFIMFTVGNKGKKVKIRTKVPLSKVHGLDIKNIQLVDSVDNIIWEKKTLVYEDVINDYCLIRHSTEEKHVFLDYKKYISSIKLELVNLIQTRIKHIQVDFKLKYFLGSGAQAKSSLLHVLNHPKSKPTPSLEFEIVNTDIKIDENELLNEMYTLFRSIFMNLPENVFLVPSFKNPLKTYMLKKQDIAGLHLENLYATTKTDGIGTIVKIKQNEIYCHFSHINYCIKYLANRTIENEILLYGEALKHKGKWSIYLIKLMKPKLENRIKEKDFVDENLKEISEKIIFKVKKYEGPFSSHSEIIDLLTFYLPVQKEGVILFYIEGKNSNSDYKIKNDNTTDHMINVVYRYMSSEPVIFGDSNTFIEFKKFSDEKGFPKDFGTGKIILTESIKYLNNIYCLEFSNVYEDVGIKKVVVPVKFISEFSSKGCLLKPRIDKTMKYMYSDYYGNQYNIVMDHIMDQNIKIEDIFNEEKLSDIGKNYADDKYRLNPEVSYFTNKRTRGPLGILSNYIKTLLISLYCSKTFLDNSNKKKVLAIDFGNGADLEKYFYGEISLLVATDPDSKAIERCNERYTKLNSGIKSKYYKFNYIQETIRSSSYVSSVREVFFFGKFDIIDWQFAIHYSFHKKHYSTIMKNLTELTASGGKVLITTMDGDKLYNLKDKKTFIIHKSLPSSENYMSVEKINSEQILVYNPSSMSKPMEEYIVKKLDIVRIFSEYGFELIDNVNFDTVINRSKKFINCVSKMEERQSTKNFFELNREALKFDVLDVEELLSYYVVYVFSKR

SEQ ID NO: 74 - protein, 842 aa, Goatpox virus
MDERDLENSLSDYIDKIVEIYDEIPNPTLSNDVNHEVELVFIQPPIITLSNVYNISSVTESYILFTVTNKEECIKIRTKVPMSKIHGLDLKNLQLVDLIDDIIWEKKTLIKEKKIDKHCIIRYSSEERHVFLDYKRYTSSIKLELVNLVQTKVKNIVVDFKIKYFLGSGAQAKSSLLHVLNHPKSKPTPTLEFEIITREKKNSRDILLNELHILFKNIFMADPKNVFLPTVIFTSPVKTIMLKKQEIHNIELDKLYITTKTDGVGTLIKINKNGIFCYFTHLNYIIKYNLLRKFDDTVILYGEAIKQNKKWFIYLIKLLKPELSNRFKERDFLIEKLTSDISDRIVFKTKKYEGPYETHSEVIDLLSTYLPLQTEGVILFYSEGNKSKIDYKIKHDNTTDHMINAVYRYMSSEPVIFGDKYTFIEFKKFSDERGFPKEHGTSKIILGNNIKYLNNIYCIEFKNIYKDVGIKNIVLPIKFISEFSFNGNFLKPRLDKTMKYFYKEYYGNQYQVVLEHIRDQELRINDIFDENKLSDLGKKYVDDEFRLNPEVSYFTNKRTRGPLGILSNYIKTLLISLYCSKTFLDNPNKRKVLAVDFGNGADLEKYFYGEIALLVATDPDKDAISRCIERYNKLNSGIKSKYYKLDYIQETIRSSVYVSKIREVFFFGKFDIVDWNFAIHYSFHPKHYSTIMKNLSELTAPGGNVLITTMDGDKLSYLLERKVFIIHKNLPSSENYMSVEKISDDKILVYNPSSMSKPMEEYIVKKSDIKRVFSEYGFVLIDCVNFDTVINRSKKFINYVSKMEERQSTKNFFELNREALKYDNIDIEELLNYYVVYVFSKR

SEQ ID NO: 75 - protein, 836 aa, Rabbit fibroma virus
MDDSKKKRGTDYIEELILLYEDVPNPVQTDDMNHEVELTFIQPPVITLSTLLPFATSQESYILFTVTNKGVKIRNRINLSKIHGLDLKNIQLVDSIDNIIWEKKTLVKEHKIDSVALVKYSTEEKYIFLDYKKYLSAIKLELVNVVQVKVKHVTVDFKFKYFLGSGAQAKSSLLHVLNHPKSKPNPSLEFEIITTDEKIDSASLRKELIALFKLVFMASPSNIILDVVFKNPVQTILLKKNELPGIDLTNLYVTTKTDGVGVLITVTNKGIYCFFTHLQYTIRYDTTFESNESVTLYGEAVKQNNVWQIYLIKLITPKVSDRFKEKEYVEERLQNICDRMTFKVKKYEGPFESHSEIIDLLTTYLPSQPEGVVLFYSDQRNQPDYKIKLDNTTDHMINIIYRYMSSEPVIFGENSTFLEYKKFSDDKGFPKDYGTGKLMLTDNVRYLNNIYCIAFTNVYEDVGIKNVVVPIKFISEFSATGELIKPRIDKTFKYLYKEYYGNQYQIVVAHIRDQNIKIGDVLDEDKLSDVGQHYANDKYRLNPDVSYFTNKRTRGPLGILSNYVKTLLISLYCSKTFLDNSNKRKVLAIDFGNGADLEKYFYGEISSLVATDPDKEAIGRCIERYNSLNSGIKSKYYKFDYIQETIRSVTYVSSVREVFFFGKFDLVDWQFAIHYSFHPKHYATVMNNLTELTASGGKVLITTMDGDLLSQLTDKKTFVIHKNLPSSENYMSVEKIHEDQILVYNPSSMSRPMQEYIVKRVNLTKIFSEYGFELIDCVHFDTIIERSKRFINSVSKMEERKSTKNFFELNREALKHEGTDIDDLLRYYIVYVFSKR

SEQ ID NO: 76 - protein, 842 aa, Lumpy skin disease virus
MDERDLENSLSDYINKIVEIYDEIPNPTLSNDVNHEVELVFIQPPIITLSNVYNISSVTESYILFTVTNKGECIKIRTKVPMSKIHGLDLKNLQLVDLIDDIIWEKKTLIKEKKIDKHCIIRYSSEERHVFLDYKRYTSSIKLELVNLVQTKVKNIVVDFKIKYFLGSGAQAKSSLLHVLNHPKSKPTPTLEFEIITREKKNSRDILLDELHILFKNIFMADPKNVFLPTVIFTSPVKTIMLKKQEIHNIELDKLYITTKTDGVGTLIKINKNGIFCYFTHLNYIIKYNLLRKFDDTVILYGEAIKQNQKWFIYLIKLLKPELSNRFKERDFLIEKLTSDISDRIVFKTKKYEGPYETHSEVIDLLSTYLPLQTEGVILFYSEGNKSKIDYKIKHDNTTDHMINAVYRYMSSEPVIFGDKYTFIEFKKFSDERGFPKEHGTSKIILGDNIKYLNNIYCIEFKNIYNDVGLKNIVLPIKFISEFSFNGDFLKPRLDKTMKYFYKEYYGNQYQVVLEHIRDQELRINDIFDENKLSDLGKKYVDDEFRLNPEVSYFTNKRTRGPLGILSNYIKTLLISLYCSKTFLDNPNKRKVLAVDFGNGADLEKYFYGEIALLVATDPDKDAISRCIERYNKLNSGIKSKYYKLDYIRETIRSSVYVSKIREVFFFGKFDIVDWNFAIHYSFHPKHYSTIMKNLSELTAPGGNVLITTMDGDKLSYLSERKVFIIHKNLPSSENYMSVEKISDDKILVYNPSSMSKPMEEYIVKKSDIKRVFSEYGFVLIDCVNFDTVINRSKKFINYVSKMEERQSTKNFFELNREALKYDNIDIEELLNYYVVYVFSKR

SEQ ID NO: 77 - protein, 842 aa, Sheeppox virus
MDERNLENSLSDYINKIVEIYDEIPNPILSNDVNHEVELVFIQPPIITLSNVYNISSVTESYILFTVTNKGECIKIRTKVPMSKIHGLDLKNLQLVDLIDDIIWEKKTLIKEKKIDKHCIIRYSSEERHVFLDYKRYTSSIKLELVNLVQTKVKNIVVDFKIKYFLGSGAQAKSSLLHVLNHPKSKPTPTLEFEIITREKKNSSDMLLNELHILFKNIFMADPKNVFLPTVIFTSPVKTIMLKKQEIHNIELDKLYITTKTDGVGTLIKINKNGIFCYFTHLNYIIKYNLSRKFDDTVILYGEAIKQNQKWFIYLIKLLKPELSNRFKERDFLIEKLTSDISDRIVFKTKKYEGPYATHSEVIDLLSTYLPLQTEGVILFYSEGNKSKIDYKIKHDNTTDHMINAVYRYMSSEPVIFGDKYTFIEFKKFSDERGFPKENGTSKIILGNNIKYLNNIYCIEFKNIYKDVGLKNIVLPIKFISEFSFNGNFLKPRLDKTMKYFYKEYYGNQYQVVLEHIRDQELRINDIFDENKLSDLGKKYVDDEFRLNPEVSYFTNKRTRGPLGILSNYIKTLLISLYCSKTFLDNPNKRKVLAVDFGNGADLEKYFYGEIALLVATDPDKDAISRCIERYNKLNSGIKSKYYKLDYIRETIRSSVYVSKIREVFFFGKFDIVDWNFAIHYSFHPKHYSTIMKNLSELTAPGGNVLITTMDGDKLSYLSERKVFIIHKNLPSSENYMSVEKISDDKILVYNPSSMSKPMEEYIVKKSDIKRVFSEYGFVLIDCVNFDTVINRSKKFINYVSKMEERQSTKNFFELNREALKYDNIDIEELLNYYVVYVFSKR

SEQ ID NO: 78 - protein, 841 aa, Squirrelpox virus
MDATPEHPLSEFLGELARAAAEVAAEPAAVDVHHELELVFIRPPLAALGAIVGLATEQTSYVLFTVSSRDGVKLRVKLPMSRVHGLDAKNVQLVDAVDDIIWEKKTLVSQRELAGGACLLRHSTEERHIFVDFKKFGSSIKLELVNLIRISARNIVTDFKFKYFLGSGTQAKSSLLHALNHPKSRPNATLEFEVLRRDADATAEQLAEELTTVARAIFMAHPDNVFLVPPVRDPIRTHMLKKQNILSLELQGLYATSKTDGVAATVRVDASGVYCFFNHLGYVIRYPALREVEEPVVLFGEAVRSAEDRRWHVHLIKLVAPTLESRLEEHEFVERRMEGLCDRVVFRAKRFMGPFASVSELTDMLTEELPKQEEGVVLFYASGEAPDMKIKKDNTVDQAVNVTFRYMSSEPVIFGDKATFVEYKRFSDERGFPREHGSGRIVIGDSVAYLNNVYCLSFAGTHDTVGLSRVVLPVKFVAEFSHDGTLLRPRVDKTMRYLYSSGYYGNQHSVVVDHLRDQALSVGDVFVGEKLAEAGRNLANDEFRLNPDTSYFVKNRTRGPLGILSNYVKTLLISLYCSKTFLDNANRRKVLAIDFGNGADLEKYFYGEVALLVATDPDARAIERGCERYNRLNSGIKSRYYKFDYVQETIRSDTFVSSIRKVFYFGRFDIVDWQFAIHYSFHPRHYATVMRNLSELTASGCKVLITTMDGDFLSSITSTRSFVINRALQESENFISFERIDDEQVLVYNPSTMAKPMAEYIVKKEALVRVFGEYGFVLIDHVDFATVVRRGRAFVEGVARMETRQSTRNFFDLNRVALADMRDTDVEELLQYYVVYVFSKR

SEQ ID NO: 79 - protein, 854 aa, Cotia virus
MEKKHYLFNKYIMEEDNIFDTSVYKYINELIKVYKNIKPHSPTDDIYDEVEAVIINPPLITLTNVFNISTKIESYMLFTVTNKEDGFKIRSRLNMSNIYGLDIKNVQLIDSIDNIIWEKKKLITEEKVDENCIIRHSTEEKHIFLDFKKYNSSIKIEFVNLIQSKIKNILVDFKLKYFLGSGAQGKSSLLHVLNYPKCKPNMSLEFEILHKDKPINETDLYNELVTIYRNIFMGYPKNIFLKRQLSYPIHTYMLKKQDISGISLDDLYITNKTDGVGTYITILDSGIYCYFSHLNYTIRYDINKKINTTTVKLYGEGLKYDGKWSIYLIKLITPSFDDRFKEKEFVSNELLNISDKIQIKTKKYYGPFTTHSELIDTIIEYLPNQQEGLVLFYKTGENSNKDYKIKNDNTTDHMINAIYRYMSSEPVIFGEDNTFVEYKKFSDEKGFPKECGTGKLILSDNVKYLNNIYCIEFYNIYNTVGLNNVVLPIKFISEFSSNGNFLRPRIDKTAKYIKCDYFGNQYNVVLEHIMDQQLKITDIFDDNKLSDIGQKYNIEKNRLNPDISYFTNKRTRGPLGILSNYIKTLLISLYCSKTFLDNSNKRKVLAVDFGNGADLQKYFYGEISLLVASDPDKDAINRCIERYNKLNSGIKSKYYKFDYINDTIRSESYISNIRKVFFFGKFDIIDWQFAIHYSFHKKYYSVVMNNLSELTASGGKVLITTMDGDKLSEITGIKKFIINKKLPESENYMSIEKISNETILVYNPSSMSKPMEEYIIKYKDISRIFLEYGFELIDCVHFNTIIDRSNRFINNVSKMEQRESTKNFFDLNREVLNDNIDDINELLEYYIVYVFSKR

SEQ ID NO: 80 - protein, 950 aa, Molluscum contagiosum virus
MDEHLERPLEYYFRELVAEFERAVRRGDSAVKKNSPKRSRAPQSLTNSKGNAGGKAEPEPELENGNTGAGAPKARTRAAPEAQAAHPPVSAHKSRPRAHAAFTSRARTEEREPGPALEPVHGPAPAPAADTTSDVHHEVELIFVRPPLVTLSHLLGIATRQESYVLFSLTSLEREGVKLRTRLPLARVHGLDMKNNQLVEAIDSILWEKKTRVAQRDFPEAHCLLRHSTEEQYVFLDFRNFNSAIRLELVNHVQARVRNIVVDFKLKYFLGSGAQTRNSLLAVLNYPKFRPSVTLEFEVLLRDPAAFSPRELLRELLVLGNLLFMAPAEHVFLMPAPKEPLTTHMLKKQDLLTLELRDLYVTGKTDGVPTFVHVAGASVYCFFSHLGYAIRYPARVTLPAPVALFGEAVRDAQSKQLTVYLIKLMAPALEDRLEEREFVLRRLQGLCERVAFQAKQYEGPFATSSELTDALAQMLAAQPEGVVLFYARGSRSGADLKLKRDNTVDQAVNVIYRYMSSEPVIFGDGVTFLEFKRFSNDKGFPKEFGTGRLVLAEGARYLNNIYCLEFADTHSGVGLRKVVVPVKFVGEFSHDGRLLRPRLAKTMLYLSNANYYGNQASVVLEHLQDQRLRVGDVFREDKLADAGKAAAVADAHRLNPDTAYFTKRRVRGPLGVLSNYVKTLLISLYCSKTFFDNPNKRKVLAVDFGNGADLEKYFYGEIALLIATDPDARAIECGRERYNKLNSGNKSKYYKFDYIQETIRSESFVASVREVFYFGKFDIVDWQFAIHYSFHPRHYATVMRNLAELTASGCRVLITTVDGDFLATLTRKRSFVIHRDLPEPENYISFEKLDSEHVLVYNPSTMAKPMVEYIVRKQALVRVFGEYGFVLVDHVDFHTVVHRSRAFIDGVAQMESRTSTKNFFELNRAALQSCRGLDVEELLQYYVVYVFAKR

SEQ ID NO: 81 - protein, 849 aa, Parapoxvirus red deer
MSSPDTGPVPGPSLDEMLVALAAKAASVDRGPAEDEVHHEVELVLVNPPLSTLAVALRLASETESFILFTVTALAKEEGKLRARMPLSRVVGLDVKNVQLVNAIDSIVWERKALVEETELRAECLLRHSTERRHLFVDFKKYMSAIRVELVNRVRVRSREVQADFKFKYFLGSGAQSKSSLLHALNHPKMRPSPTLEFEVVPSEAAVDEAAVLAELRAMAKALFMAPAEAVFLEPPPRMPVKTHMLPKQEIPSLDLQGLYAVSKTDGVPAAVTVDESGVYCAFAHLGYTIRYAAARAPAKQYRLRCEAVRHVGERVWSMYIILVEEPAGVDRVAAAEAAAEELRGVCARVEFKAKRVEGPFYSTSELVDFLAGALKAEPEGVVLFYASGERAARDFKVKRDNSVDQTANVVFRYMSSEPIVFGEGSTFLEFKRYSNDNGFPKEYGSGRIFLREDVIYHNNIYCVEFARTHADVGLRSVVVPVKFVGEFSSEGALLRPRLDKTALYFRNASYYGNQHSVVLEHARDQLLAVGDVLDESRMAAVGHTLANDAFRLNPDTPYFTNRRTRGPLGVLSNYVKTLMISLYCSKTFLNNPERRKVLAVDFGNGADLEKYFFGEIVSMVATDPDARAIERAMERYNRLNAGIKSRYYKFNYIQETIRSDTYVESIRQVMYFGRFNIVDWQMAIHYSFHPRHFATVMRNLRELTAPGCKVLVTTMDGDYLSTLAGKVSFVINKNLQESENFMSLERVAEDQVLVYTPSTMAQPMAEYIVRRADIVRLFADSGFDLVDHADFETVIRRSRRFVEGVSRLETRPSTKNFFELNRTALAEMEGTDVAALLKCYVLYVFSKR

SEQ ID NO: 82 - protein, 842 aa, Bovine papular stomatitis virus
MSAPSLDELLVALAAKAAAVDRGSPADEVHHEVELVLVHPPLATLATALRLASETESFILFTVTALAKEEGKLRARMPLSRVVGLDVKNVQLVNSIDTIVWERKSLVEETELHPGCLLRHSTERRHLFVDFKKYLSAIRVELVNLVRVRSKEVIADFKFKYFLGSGAQAKSALLHALNHPKIRPSATLEFEVVPSGETLDEASVLAELRAMAKALFMAGSDSVFLTPALSAPPVRTVMLQKQEIPALELEGLYSVSKTDGVLAAVAVTEDGVRCSFGHLGYTIRYPLAKAPKCEYRLWCEAVRPVGERVWAMHVLFVEEPQGSDRIADAAAAAEALCGVCARVEFKSKRVDGPFSATSELVEHISSAIKTEPEGIVLFYASGERSKLDFKVKRDNTVDQTTNVTFRYMSSEPIVFGDGATFLEFKRFSNDKGFPKDYGTGRIFLRDDVIYHNNIYCIEFTKTHREVGLASVVVPVKFISEFSQEGYLLRPRPEKTMKYLRNPSYYGNQHSVVLEHARDQLLSVMDVFDENRMAAVGHTLANDAFRLNPDTPYFTNRRTRGPLGVLSNYVKTLMISLYCSKTFLNNPEKRKVLAVDFGNGADLEKYFFGEIASMVATDPDARAIERAMDRYNRLNAGLKSRYYKFNYIQETIRSETYVESIRQVMYFGRFNLVDWQMAIHYSFHARHFATVMRNLRELTAPGCKVLITTMDGDYLATLTGKVSFVINRNLQESENFMSVERVAEDQVMVYTPSTMAQPMTEYIVRREDIVKLFADNGFDLIDHANFETVIRRSRRFVEGVSRLETRPSTKNFFELNRNALEEMDRTDVAELLKRYVLYVFSKR

SEQ ID NO: 83 - protein, 841 aa, Orf virus
MDAPSLDCMLAALAAKAASVDRGAPEDEVHHEVELVLVDPPLSTLAATLRLASETESFILFTVTALAKEEGKLRARVPMSRVVGLDVKNVQLVNAIDSIVWERKALVEETALQEGCLLRHSTERRHLFVDYKKYLSAIRVELVNRVRVRSKEVVVDFKFKYFLGSGAQAKSSLLHALNHPKVRPSPTLEFEVVPAGEAVDEAAVLTELRAVAKALFMAPTDAVFLLPPAEMPVRTLMLQKQEIPALDLDGLFAVSKTDGVSASVRVDENGVFCAFSHLAYTIRYPLAREVQGRYRLWCEAVRPVGERVWSMFVLVVEEPAGDDRVAAVAGAVEALRGVCARVEFKPKRVDGPFSATSELVEHIKSALQTEPEGVVLFYARGEKSKRDLKVKRDNTVDQTTNVMFRYMSSEPIVFGEGSTFLEFKRYSNDRGFPKEYGAGRIFLREDVVYHNNIYCIEFTKTHLEVGLRSVVVPVKFIGEFSQEGYLLRPRLAKTECYFRNPSFYGNQHSVVLEHTRDQLLSVGDVFDESRMAAVGQTLANDAFRLNPDTPYFTNRRTRGPLGVLSNYVKTLMISLYCSKTFLNNAERRKVLAVDFGNGADLEKYFFGEIASMVATDPDARAIERAMERYNRLNAGLKSRYYKFNYIQETIRSETYVESIRQVMYFGRFNIVDWQMAIHYSFHPRHFATVMRNLRELTAPGCKVLITTMDGDFLSTLSEKTSFVINRNLQESENFMSIERVADDQVMVYAPSTMAQPMTEYIVRRADIVKLFADNGFDLVDHANFETVIRRSRRFVEGVSRLETRPSTKNFFELNRNALTEMDSTDVAALLKIYVLYVFSKR

SEQ ID NO: 84 - protein, 841 aa, Pseudocowpox virus
MDAPSLDCMLAALAAKAAAVDRGAPEDEVHHEVELVLVNPPLSTLAATLRLASETESFILFTVTALAKEEGKLRARVPMSRVVGLDVKNVQLVNAIDSIVWERKALVEETALQEGCLLRHSTERRHLFVDYKKYLSAIRVELVNRVRVRSKEVVADFKFKYFLGSGAQAKSSLLHALNHPKVRPAATLEFEVVPAGEAVDEAAVLAELRAVAKALFMAPTDAVFLTPPADMPVRTLMLQKQEIPALELEGLFAVSKTDGVSASVRVDAGGVFCAFSHLGYTIRYPLAREVKGVFRLWCEAVRPVGERVWSLFVLFVEEPAGEDRVAAVAAAVEALRGVCARVEFKPKRVDGPFSATSELVEHIKGALQTEPEGVVLFYASGEKAKRDLKVKRDNTVDQTTNVMFRYMSSEPIVFGEGSTFLEFKRYSNDRGFPKEYGAGRIFLREDVVYHNNIYCIEFTKTHLEVGLRSVVVPVKFIGEFSQEGYLLRPRLAKTELYFRNPSFYGNQHSVVLEHTRDQLLSVGDVFDESRMAAVGQTLANDAFRLNPDTPYFTSRRTRGPLGVLSNYVKTLMISLYCSKTFLNNAERRKVLAVDFGNGADLEKYFFGEIASMVATDPDARAIERAMERYNRLNAGLKSRYYKFNYIQETIRSETYVESIRQVMYFGRFNIVDWQMAIHYSFHPRHFATVMRNLRELTAPGCKVLITTMDGDFLSTLTEKTSFVINRNLQESENFMSLERVAEDQVMVYAPSTMAQPMTEYIVRRADIVKLFADNGFDLVDHANFETVIRRSRRFVEGVSRLETRPSTKNFFELNRNALAEMDSTDVTALLKIYVLYVFSKR

SEQ ID NO: 85 - protein, 848 aa, Turkeypox virus
MDKYISRKPLSFYFEELVNMFMESVNNAEIDDSKHHEIELILFKPPIITLTNLYYIASSMESYIEFTMLPINKPNTKFRNRMSLSKIHGLDVKNNQLVENIDNIIWEQKTLIKKKDIADNSSCVIRYSIEEKTLFVDYKKYNSSIKLELVNLIRTRLRNIVIDFKMKYFLGSGAQSASSSSLLCALNHPKNKPSLILEFEIMIQDKTVTRNMLLDELCMVANALFLSEPRHVRLCPYLQPKLKTYLLKKQELINIDTDNLYITGKTDGIFSYVYIYHRSIFCYFNHLGYIKDYDISVDVEEPIYLYAEMRKENNIIYFTVIKVLLPELDDRLAELEFVNSNLCNLHERLVFSTKQFEGPFESTSGLVDGIEEMLKKEREGVILFYSKGNDSMLDYKIKKDNTIDQCVNIIYRYMSSEPIVYNDKGSFIEYKKYSNDKGFPKEFGTGKLVIGNGVDYINNIYCLEFTNINPATGIDKIILPIKFISEFSHNDELIQPRIDKTMKYLYEHSYYGNQLSVIMEHISDQKLKLGDIFEEEKLAEVAHLQLKDSMRLNPEGQYFLTNRVRGALGVLSNYVKTLMISMYCSKAYLDDHNKRKVLAIDFGNGADLEKYFYGEIALMVATDPDDNAIETGKKRYNKLNSGDKSKYYKFDYIKETIRSGSYVSSIRQVFYFGRFSLVDWQFAIHYSFNPKHYNTIMSNLRELTASGCKILISTMDGDYIDTLKEKKKFVIHKLLPESENYLSIEKIDDDQILVYNPSSMTKPMAEYIVRKNTLIRVFREYGFQLLDVCNFKTIINRNIDFVEGVSRLENRGSTKNFFELNRKALSECAGTDVLELLGYYVVYVFSKV

SEQ ID NO: 86 - protein, 846 aa, Canarypox virus
MDNYILEKPLGSHFEELVDTFFEAIRNVSEVDKSKHHEVEMQIFKPSIITLSNLYNISTTTESYIEFSMMPIDKKNTKYRNRIPLSKIHGLDIKNSQLVENLDGFIWEEKTLISEKRVSECTNIRIRHSVEQKTLFVDYKRRNGSIRLELVSVVRATLRNIVVDFKIKYFLGSGAQSASSLLYALNNPKNKPNLYLEFEISTSDKNISKQLLLNELNTIGNALFLSKVDKIRLCPRIKLVLKTYLLKKQEIINLNIENLYITSKTDGVFTYVLLQNKSIYCYFSHLGYIKEYTANREIDEKVYLYAEMRKENGILYFTVIKVLNPRMKNRLDELKFVNKNLQNINDRLVFVTKCYEGPFDSTSDLVFAIEEMLKSEHEGVIIFYSCGEESSLDYKIKKDNTIDQCVNVIYRYMSSEPVVFSDNGPFIEYKRYSDDKDFPKEFATGKLSLGNDVKYLNNIYCIEFTNLPEHTGVEKIIVPIKFIAEFSFNDKMIQPRIDKTMRYLYTENYYGNQLSVIIDHLNDQKINIGDVFEEDKLAEVAHKQLKDSLRLNPEGNYFIANKKRSALGVLSNYVKTLLISLYCSKAYLDDHSKRKVLAIDFGNGADLEKYFYGEIALMVATDPDEMAIETGKKRYNNLNSRDKSKYYKFNYIQETIRSPTYVDSIREVLYFGKFSIVDWQFAIHYSFHPIHYSTIMKNLYELTESGCKVLISTMDGDYLDTLKDKKKFIIYKSPETENYLSVEKIDNDKILVYNPSSMTKPMAEYIVRKDTLVRVFKEYQFSLIDNCSFKTIIDRSINFVKGVSRLETRDSTKNFLELNRNALEDCEGTDVLELLDHYMIYVFSKN

SEQ ID NO: 87 - protein, 852 aa, Penguinpox virus
MDKYISKKPLSCYFEELVDTFISVVNDIDKVNESKHHEVELILFKPPIITLTNLYNMATATESYIEFTMLPVDKPNTKFRNRIPLSKIHGLDVKNNQLVESLDGFIWEEKSLLLKKDISDNSSAVIRHSVEEKTLFVDYKRRNASIKLELVSLVRAKLRNIVIDFKMKYFLGSGAQSANSSSLLCALNHPKNKPSLYIEFEIMTQDKNISKKKLLEELNMSASALFLSQPKYIRLCPSINPILRTHLLKKQDIINLCTEDLYITSKTDGIFSHIYIEKKSIFCYFGHLGYIKEYTASRELEEPIYLYAEMRKEESILYLTVIKVVKPCMEDRLSELEFVKNNLTSIHDRLVFVTKCYDGPFESSSDLVASIEELLKTEQEGIILFYSKGENSTTDYKVKKDNTIDQTVNVIYRYMSSEPIVFNDKGSFLEYKRYSNDKGFPKEFSTGKLDLGEGVEYVNNIYCIEIKKLNPCTGITNLVLPIKFIAEFSHNDELIQPRIDKTMKYLYENSYYGNQLSVIMDHLNDQKLRIGDVFEEEKLADVAAAHIKLKDSMRLNPDGNYFLSSRVRGALGVLSNFVKTLLISLYCSKTYLDNHSKRKVLAIDFGNGADLEKYFYGEIALMVATDPDDNAIETGKKRYNERNAGDKSKYYKFNYIKETIRSETYVSSIRQVLYFEKFNLVDWQFAIHYSFHPKHYSTIMTNLHELTESGCKVLITTMDGDYLDTLKEKKKFIIRRLLPETENYLSIEKIDDDKVLVYNPSSMSKPMAEYIVRRETLIRVFRDYKFKLIDSCSFKTIIDRNISFINGVSRLESRGSTKNFFDLNRKALEECDDTDVLELLSHYMVYVFSKEV

SEQ ID NO: 88 - protein, 851 aa, Fowlpox virus
MDKYISKTPLSCYFEELVDTFISVVNSINKVDESKHHEVELILFKPPIITLTNLYNMATTTESYIEFTMLPVDKPNTKFRNRIPLSKIHGLDVKNNQLVESLDGFIWEEKSLLLKKDISDNSSAIIKYSIEEKTLFVDYKRRNASIKLELVSVVRAKLRNIVIDFKMKYFLGSGAQSANSSSLLCALNHPKNKPSLYIEFEIMMQDKNISKKKLLEELNMSASALFLSHPKYIRLCPSINPILRTHLLKKQDIININTDDLYITSKTDGIFSHVYIEKKSIFCYFSHLGYIKEYTASREIEETIYLYAEMRKEESILYLTVIKVLKPCMEDRLSELAFVKNHLTGIHDRLVFVTKCYDGPFESSSDLVVSIEEMLKTEQEGIILFYSKGEDSTTDYKVKKDNTIDQCVNVIYRYMSSEPIVFNDKGSFLEYKRYSNDKGFPKEFSTGKLDLNGSVEYINNIYCIEIKHLNPCTGITNLVLPIKFIAEFSHNDELIQPRIDKTMKYLYESGYYGNQLSVIMDHLNDQKLRIGDVFEEEKLADIAAHMKLKDSMRLNPDGNYFLSNRVRGALGILSNFVKTLLISLYCSKTYLDNHSKRKVLAIDFGNGADLEKYFYGEIALMVATDPDDNAIETGKKRYNERNAGDKSKYYKFNYIKETIRSETYVSSIRQVLYFEKFSLVDWQFAIHYSFHPKHYSTIMTNLQELTESGCKVLITTMDGDYLDTLKEKKKFIIRKLLPETENYLSIEKIDDDKVLVYNPSSMSKPMAEYIVRRDTLIRVFREYKFKLIDSCNFKTIIDRNISFINGVSRLESRGSTKNFFELNRKALEECNDTDVLELLSHYMVYVFSKEV

SEQ ID NO: 89 - protein, 848 aa, Nile crocodilepox virus
MENKLGEPLSAMLDELVDYFESAFRENRFDAARHNEVELILLNPPLSAVSVLHTIATVEESYVQYVLKAKDAKIRNRLSVKDVHGLDVKNYQLVERLDDANWERKAPVWEKSFPGATIKHSTEESHPFTDYRNYSGNIKLEFVNLVRARAKHLIVDAKFKYFIGNGSQNYNSLLYALNDPAAKPGVTLEFEIDVSREHLEREGFSFAELRASLYTVCQALFLAPADSVFLVQGGGPRPPVPTNMLKKYQLQTLETADLYVTEKTDGVLTYVLLRDKDIFCHFAHLGYFIRYRGRRKFAEPVSLMGEMTRAGSGEKVVHFIKLQTPALPDRLEERAFVEERLSDLGGGITIAVKRYHGPYATNGDLIAACATLLREYREGVILFYRHAAPCDWKLKKVNTVDQAVNVVYRYMSNEPIILGDRDTFVEFKRYSNAHGTPKEFGFGKLVLSDGVNYLGNIYCLEFLQSEHDTGLERVLVPVKFVGEFSTAEGDDSLVRPRLEKTMLYLYSRNYYGNQEAVILEHLEDQRVRLGELLTGAPDVMAEAGKRVARDALRLNPDGSYFSQNRTRGPLGILSNFVKTQTISLYCSKTFMDNNAKRKVLAVDFGNGADLEKYFYAEAAVLIATDPDPAAIAEANSRYNKLNSGSKSKYYKFAYLQATIRSDAYLDEVRKTFYSGRFDVIDWQFAVHFSFHPLHYSTVMRNLAELAAPGAKVLITTMDGDYVASLAEERRFVIHRTQAEDNYLSIEKISDEKALVFSPTTMKRPMEEYIVRRADLNRVFEEYGFRAIDYVTFYDVIARNRKFLAGVSKLEARPSTSKFFALNRDAVNFEGTDLEELLRRYVVYVFCKA

SEQ ID NO: 90 - protein, 873 aa, Salmon gill poxvirus
MNNTGSEIVAEYGKMYEKIRESNMDLEITELEFTQFDPSLLSLSKMFSNPNIKPLTDSYLEYILNKTSDEGNNIKIRIRIDFAVVGGLELNNKQLLDYVEHGCWESKETKDIWLSPDEFGRITSATEKQGTYINKVIQSGKINMIFVNRARVKFSDFVVDFKLKRKLGNCRQGNISNLYKSVNNAMYPPNPSLEIEHTGQFKKPWKDVKLEFTKVISWIIGHPIEEILTTTTPLFKIIPTSVITPAYLMNSIDPTQHKLTPKINGVGVMFKIDKKHVLVQQMLGPKVISIWRYKHLLTVTEDIYGSGEFIFDSDHSKCIYPYMILGHDVSTYKWEVQDCANLPYDHVLIKSKQWTGPFNDITDMLTAIYEMTVSKHSYETDGLILSSSYRHGKCDYKIKATSDIDIVGKVRFTYAGKSDPRQMATDGMILTVDYMSKNATNELVKINDNRIKLSPEFDYLNDIFCVKTTRVDPQLVKLSHAVVPIGFICEYDVRTKEIMIRLTKSSTHLWTKYLGNNWTTIQTIQHSVPILADLKLLSKWIKSPEARDHTVLQDVKINGTKSMNEMDDGLDPDRLNPKTTYFKENRIRSPLGYISNFVKSLLISLYASKMFYSNSKKARVCSIDFGNGADLTKYFYAGIQELIATDPDSAAIDTAHDRYMKLNKNEKSNYYRFNYLKTSIRNENFVSVIRTVTDQLNFDVIDWQFAAHFSWNHKHIQNIMHSLCEITKPGGRVLITTMNGKGLESILDKDDSVTFKIHPIEPTGYTTITKTSPTTFSVLTPLTTTTAMTEYIIDPDQMIKTFYDYGFVLLDQGRFDEVFNINVPFFKAGSLLETRPSTASFFAQQRGVVHDIKNTQLDQLLKYYIYMVFQRGT

SEQ ID NO: 91 - protein, 891 aa, Anomala cuprea entomopoxvirus
MEYEINVLIKEFIEFYNNVTYIDDDKLHNEVEITYLFPNLILLSNLYQYDECKKTTYLEFSLSYTDNKKRIKFRQIVPYTTQDKFEIKNSYLANKLFNVNKLDIKSEISNKNILLNESNKEKIIFRHSTEKKIIDSDITLPSKQELLKNQVRLTFVNSIRIMIDNLIKIEFKYKANLGSASSNSLALSTYLNNIDTARILTTYYLEIELLSNTKIDNDILINVLNKSFGYIFSIRNLDNFSLSISNEYVPIKTFMITYDKLHIIDKSAYVMTPKINGESVSFYVENGICNITIYNFIYKNINCNINKNVIMSGEGELIIIDNIKHIFPFYFNLIKDNKISYTDRYKQIEFYNTSIINFKSNMKIHFRNKNIFKFESNNTVNEVLKFYRSILINDMYKDINDGVILLDISNNNVKKDYKFKLDNTVDIIAKLETHKGIFRTQKDGLYLTLSLYNYDNKNFVKMLEINLKNEDLTTMIHDKKLISYDNVINMLLFKNVDFGPKILVSPIYCIVEYSFMSSTIIKLRIEKTNKFFRNNYNGNNLNVILSSKQFHEKYNMLSVIDNKLDYMIELNKSNNLLTEETHRSKLILNKDVQNYFLEQTTRTSLNILTNYIKTEAISITVSKLCSIIPNRHVLSIDIGRGGDLRKYYYVGISGMLGTEPDISALETARSRYKEFQISSRAKSSVYKFNSINISILDDNYINRVKEIYLIPQRIKFFGVIEWQLAIHYSYNEDTKNNILYKLKNLAGDGTKIIITCLNGDLLSEKLQNNPHLNYKISDTIYYKISKIDDNRISVLYNATMSTWLEEFLIKKTIINDFKNYNFVLDDIFTFDKIFNNDINKMLRVLAVFNRKSTKDFYSNIINDKNIYENKELQELLSFFIVYIFRYSSSLT

SEQ ID NO: 92 - protein, 860 aa, Melanoplus sanguinipes entomopoxvirus
MEFNINSIIDKFWQFYSTHNPVDNVHNEIELTYLFDNLLLLSNIASYTETKKKLQLEYIIKYVDKSIKLRQRHEYDYPNFEITNTYMIQKLTNQWTIKKLINKIEENIGNEKFIIAHNTEEDNIKNNMIIPPKKLIMSNVTIHILSSIYFIINGNVRVEFKLKGTLGAADNNKMMLQTYLNNVLTYKQFTSYYIEIEILNKLSKDEFYRDITNAFRYIYSINNLNNFALSTKNISPSVKTFMLPFDSLYLMDKSKYFLTSKIDGEVVQFTVKNGICDIVLYNFIFKNKQTNIPNHIVMKGFGEYKKIDNVKTIYPFVFTEIYSTDSKQKYNTRYEMIKFYNDNIKNKEFDITFKHKPIIPIEKDIVNEAIAYYKSLDEKITDGVILLDKESNIDYKLKIDNTVDVIASLNTHKSPNKIHKDGIYMTFNLYMNDEKNITELLKVEMKSNDLITYDNDINMLKFKNIHNRYGKNILYAPLCCIVEYSFLKSKIVNIRLDKTTKFFKSNYYGNSLKVILDSKTFHEKYVPLDTVGIDYLYTMFKINNEIYDKKNLILNQNVEKYFKEPIENNQQQRPPLNIFTNLIKTEAISIAASKLCAEIPNRHVLSIDIGRGGDINKYYYIGISGMLGTDPDISALSEAQERYNSLQTRKRVNSTVYKFSSLNISILDHDYLNKVKSTYMTQQKIKYFGLIEWQMAIHYSYNVDTKNKILNILKNLSTDGTKVIITCLNGNKIKNLLINNQNIKYKIQDNIYYNISKVNDDKIKVLYDATMTTWLEEYLIYDTIIEDFNKYNFILDDMFEFKDIYNNDAMLVLKTNSLFPRKATSVFYKNILNQNTKDNQVLELMNLFKVYIFKYKSYKK

SEQ ID NO: 93 - protein, 872 aa, Amsacta moorei entomopoxvirus
MSIDVSDIINDCIKFYSNINFDSNPNVNNEIEFTYINPDLRILSNIYTDNNESKKKTYLEYVLKFANKKSKLRQKYKYDYPTFEIANSYFLDKLTNNWERKTIISEDKININKNEYILLRHNTEYQDNDIELPLLNDILDKINVLFVSQLYIIINDLIKVEFKIKSNIGPLSSNKLLLSTHFNDIETYRKNITYYLEIEVLSKTKLDNNVLYDNLVKSFEYIYKSKNISNISLVTIKNKPKIKTHMIQYNKLNTIDKESYIMAIKIDGDVVEFNVMNGICNIIIYDMVYKNFSCNIDKNIQMIGMGEYIKVDNVKKIYPFYFSKLSYNNKKIINNILDRYKQIQYYNDNLLCHKPNMQIKFENKLTLKFDENNVTTNVLKFYKSIENSSFKNIYDGIVLLDITDNDSKKDYKFKIDNTVDVICKLDTYRGTYILHNDNKLYITFTLYQYDNKNFTEILKYEEKNEIIEYNNYVNLLIFNNNNKFGPKKMLSPIWCIVEYSFLESKIIGLRIDKTNNFYRQNYNGNNLDVILTSKHIHEEFPSNYNIDYLMSLNETINVIDNNPHRSKLLLNKEVNKYFMNNTIRTSINILTNYLKTNGISMAISKLVTTLPNRYVLSIDIGRGGDLTKYYYVGITGMLGTDPDIFAIKEARDRYKKLQTISNAQASIYKFDSLNMSILNDNYENEIKNKFMTHHKIQYFGVIEWQLAIHYSYNNNTKDMILLKLKNLSNDGTKVIITCLDGDEITNRLNENPNLIYNIQPGITYKISKISDDKISVLYNATMTEWLEEYIITDKIIDDFAMYNFILSDVCKFDDIFKYNSDKSVEVLSNFLRKSTKKFYNDIKNDKNIYNNDDIKKIMSLFKVYTFVYSSCK

SEQ ID NO: 94 - protein, 872 aa, Mythimna separata entomopoxvirus
MSIEINEIINKFVKFYDNIKLDTNENIKNEVELTLINPDLMLLSNIYTENNESKKKTYLEYNLKFSKKKSKLRQRHEYDYSTYEIPNSHLTDRLTNNWETKTVIDEEKIDINKHEHVLMRHNIEYIDNNIELPLINDIFDRISVIFVSQVYIIIDSVLKIEFKIKSYIGPLSSNKLSLSTHFNDIDTSRKNISYYLEIEILPNIKLENNILQEKLEKAFSYIYKSTNISNLSLVTIKEPSRIKTFTIQYNKLNTIDKDSYVMAIKIDGNVVNFTVKNSICSVIIYNVIYKNYKCNIDKNIEIKGMGEYIKVNNVKKIYPFYFTEIKYVNRKATNIIENRYDQIQFYNSIITSFKEPMQIKFENKLTLKFNENNVSTNVVNFYKSIDNSNMKDIYDGIILIDISNNKDKKDYKFKIDNTVDIVCRLDTYRGVYILHSGGKLHISFSLFAYDDKNFAELTKYTVKSDIIKYISDANLLVFNNNDKFGPSKLLSPIYCIVEYSFLHSKIIGLRIDKTNNFYRQNYNGNSLDVIILSKQIHEQFPSNYNIDYLLSLNESSNIIDNNPHRSKLLLNKKVDKYFLDNTVRTSINILTNYMKTNAISMSISRLVTVLPNRYVLSIDIGRGGDLTKYYYVGISGILGTDPDTIAIQESRERYKNLQLKSNAQSSVYKFHTLNISILNDNYENDVKQSFMNQQKINFFGVIEWQLAIHYSYNNNTKDSILLKLKNLSSNGTKVIITCLDGNELINRLNINEHIIYNIQPGITYKITKISEDRISVLYNATMTNWLEEYIITDGIIYDFAKYNFILHDMFTFEDIFNKNTYKTIDILSNFGRKSTNMFYKTIKNDSNIYNNEDINKLMSLFKVYIFIYSSYN

SEQ ID NO: 95 - protein, 872 aa, Choristoneura rosaceana entomopoxvirus
MSIDITDIINKYVQFYDKVNLDNNPNINNEVELTYINPDLMLLSNIFTDNNESKKRTYLEYNLRFTNKKSKLRQRHKYDYPTFEIANSYFLDNLTNNWEKKTIIYEEKIDINKNEHILLRHNTEYQDNDIELPLLKDILDKINVIFVSQVYIIINNIIRVEFKIKSNIGPLASNKLLLSTHFNDMETYRKNISYYMEIEILSNIKLDNTTLRDNLIKAFEYIYKSKNILNLSLVTIKNSPKLKTHMVQYNKLNSIDKDAYIMTIKIDGDVVEFNVKNGICNIIIYNIIYKNFTCNIDKNIQMRGLGEYIKINNIRKIYPFYFFELSYTNKKIITNISDRYQQIQYYNNNLMTFKSSLQIKFENKLTLKFDENNVSTNVINFYKSIDNSNLKDIYDGVILLDISDNNLKKDYKFKIDNTVDVICKLDTYRGTFILHKDNMLYITFTLYQYDNKNFTEILKYEVKNDIIEYNNYVNLLLFTNNNKFGPIKLVSPIYCIVEYSFLQSKIIGLRIDKTNNFYRQNYNGNNLDVIITSKQIHEQFPLNYNIDYLISLNNTTNIIDNNPHRSKLLLNKEVNKYFIDNTIRTSINILTNYIKTNAISMSISKLVTTIPNRYVLSIDIGRGGDLTKYYYVGITGMLGTDPDVFAIEEARDRYKKLQLKSNAQSSVYKFHTLNMSILNDKYEQEIKNNFMNQHKISFFGVIEWQLAIHYSYNDNTKDSILLKLKNLSRNGTKIIITCLDGNELINRLNINPNLIYNIQSGITYKISKVSDNKISILYNATMTEWLDEYIITNDIIDDFAKYNFILDDVFTFNDIFNDNTHKSIEVLSTFSRKSTNLFYATIKNDNNIYNNEDIKKLMSLFKVYVFIYSSHN

SEQ ID NO: 96 - protein, 872 aa, Choristoneura biennis entomopoxvirus
MSIDITDIINKYLQFYDKVNLDNNPNINNEVELTYINPDLMLLSNIFTDNNESKKRTYLEYNLRFTNKKSKLRQRHKYDYPTFEIANSYFLDNLTNNWEKKTIIYEEKIDINKNEHILLRHNTEYQDNDIELPLLKDILDKINVIFVSQVYIIINNIIRVEFKIKSNIGPLASNKLLLSTHFNDMETYRKNISYYMEIEILSNIKLDNTTLRDNLIKAFEYIYKSKNISNLSLVTIKNSPKLKTHMIQYNKLNIIDKDAYIMTVKIDGDVVEFNVKNGICNIIIYNIIYKNFTCNIDKNIQMRGLGEYIKVNNIRKIYPFYFFELSYTNKKIITNISDRYQQIQYYNNNLMPFKTSLQIKFENKLTLKFDENNVSTNVINFYKSIDNSNLKDIYDGVILLDISDNNLKKDYKFKIDNTVDVICKLDTYRGTYILHKDNMLYITFTLYQYDNKNFTEILKYEVKNDIIEYNNYVNLLLFTNNNKFGPIKLVSPIYCIVEYSFLQSKIIGLRIDKTNNFYRQNYNGNNLDVIITSKQIHEQFPLNYNIDYLISLNDTKNIIDNNPHRSKLLLNKDVNKYFIDNTIRTSINILTNYIKTNAISMSISKLVTTIPNRYVLSIDIGRGGDLTKYYYVGITGMLGTDPDVFAIEEARDRYKKLQLKSNAQSSVYKFHTLNMSILNDKYEQEIKNNFMNQHKISFFGVIEWQLAIHYSYNDNTKDSILLKLKNLSRNGTKIIITCLDGNELINRLNVNPNLIYNIQSGITYKISKVSDNKISILYNATMTEWLDEYIITNDIIDDFAKYNFILDDVFAFNDIFNDNTQKSIEVLSTFSRKSTNLFYTTIKNDNNIYNNEDIKKLMSLFKVYVFIYSSHN

SEQ ID NO: 97 - protein, 869 aa, Adoxophyes honmai entomopoxvirus
MSIDINDIISKYIKFYENVKFDTSKNVNNEVELTYINPDLMLLSNIFTDNNESKKKTYLEYNLKFINKNSKLRQIHKYNYSTFEIANSYFLDKLTNNWENKTVLSEEKIDINKQEHILLRHNIEYQDDEVKLPLLNDLLDKINVIFVSHVYIIINSIIRVEFKIKSNIGPLSSNKLLLSTHFNDIDTYRKNISYYLEIEVLPQAKVDSKILYENLIKAFEYVYKSKNISNISILKTKEIPKIKTHMIQYNKLNTIDKDSYILAVKIDGDVVEFNVKNGICNITIYNNIYKNFTCNIDKNIQMRGLGEYIKVNNIKKIYPFYFYEISYVDKNNIIDRYEQIQFYNNNLLNYKNAMQIKFEIKLVLKFDENNVSTNVLNFYKSIDKSNLKDIYDGVILLDTSNNNLKKDYKFKIDNTIDIVCKIDTYRGIFVLHNDNNLYITFTLYQYDNKNFVEISKYEVKNDIIKYNNYANLLIFNNINKFGPNKLLAPVYCIVEYSFLQSKIIGLRIDKTNNFYRQHYNGNNLEVILMSKQIHEQYPKNYNIDYLMSLNESINIIDNNPHRSKLLLNKNINKYFMDNTVRTSINILTNFIKTNAISISISKLVAVLPNRYVLSIDIGRGGDLTKYYYVGITGILGTDPDPFAIQEARDRYKKLQLKSNAQSSVYKFHTLNISILDDKYIQEIHRNFMSQQKIKYFGIIEWQLALHYSYNNNTKNTILRNIKTISGDGTKLIITCLDGNELLNRLSVNPNLIYNIQPGITYKISKISDEKISVIYNATMSDWLEEYIITDSIISDFEKYNFIIHDMFSFNDIFNDDTQKLIDVLSTFSRKSTNIFYNNIKNDSNIYNNDDIKKLMALFKVYVFIYSSSN

SEQ ID NO: 98 - protein, 287 aa, Cowpox virus
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYCIIKLPTLFGRGVIDTMRIYCSLFKNVRLLKCVSDSWLKDSAIMVASDVCKKNLDLFMSHVKSVTKSSSWKDVNSVQFSILNDPVDTEFINKFLEFSNRVYEALYYVHSLLYSSMTSDSKSIENKHQRRLVKLLL

SEQ ID NO: 99 - protein, 287 aa, Ectromelia virus
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYCIIKLPTLFGRGVIDTMRIYCSLFKNVRLLKCVSDSWLKDTAIMVASDVCKKNLDLFMSHVKSVTKSSSWKDVNSVQFSILNDPVDTEFINKFLEFSNRVYEALYYVHSLLYSSMTSDSKSIENKHQRRLVKLLL

SEQ ID NO: 100 - protein, 287 aa, Variola virus
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYCIIKLPTLFGRGVIDTMRIYCSLFKNVRLLKCVSDSWLKDSAIMVASNVCKKNLDLFMSHVKSVTKSSSWKDVNSVQFSILNDPVDTEFINKFLEFSNRVYEALYYVHSLLYSSMTSDSKSIENKHQRRLVKLLL

SEQ ID NO: 101 - protein, 287 aa, Taterapox virus
MDEIVKNIREGTHVLLPFYETLPELNLSLGKSPLPSLEYGANYFLQISRVNDLNRIPTDMLKLFTHDIMLPESDLDKVYEILKINSVKYYGRSTKADAVVADLSARNKLFKRERDAIKSNNHLTENNLYISDYKMLTFDVFRPLFDFVNEKYCIIKLPTLFGRGVIDTMRIYCSLFKNVRLLKCVSDSWLKDSAIMVASDVCKKNLDLFMSHVKSVTKSSSWKDVNSVQFSILNDPVDTEFINKFLEFSNRVYEALYYVHSLLYSSMTSDSKSIENKHQRRLVKLLL

SEQ ID NO: 102 - protein, 287 aa, Camelpox virus
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYCIIKLPTLFGRGVIDTMRIYCSLFKNVRLLKCVSDSWLKDSAIIVASDVCKKNLDLFMSHVKSVTKSSSWKDVNSVQFSILNDPVDTEFINKFLEFSNRVYEALYYVHSLLYSSMTSDSKSIENKHQRRLVKLLL

SEQ ID NO: 103 - protein, 287 aa, Monkeypox virus
MDEIVKNIREGTHVLLPFYETLPELNLSLGKSPLPSLEYGANYFLQISRVNDLNRMPTDMLKLFTHDIMLPESDLDKVYEILKINSVKYYGRSTRADAVVADLSARNKLFKRERDAIKSNNHLTENNLYISDYKMLTFDVFRPLFDFVNEKYCIIKLPTLFGRGVIDTMRIYCSLFKNVRLLKCVSDSWLKDSAIMVASDVYKKNLDLFMSHVKSVTKSSSWKDVNTVQFSILNDPVDTEFINKFLEFSNRVYEALYYVHSLLYSSMTSDSKSIENKHQRRLVKLLL

SEQ ID NO: 104 - protein, 287 aa, Raccoonpox virus
MDEIIKNIREGTHILLPFYETLPELNLTLGKSPLPSLEYGTNYFLQISRVNDLNRMPTDMLKLFTHDIMLPESDLDKVYKILNINSVKYYGRSTKADAVVADLSARNKLFKRERDAIKSNNHLTENNLYISDYKMLTFDVFRPLFDFVNEKYCIVKLPTLFGRCVVDTMRIYCSLFKNVRLLKCVSDSWLKDSAIMVASDVCKKNMDLFMSHVKSVTKSSSWKDANSVQFSILNDPVDTEFINKFLEFSNRVYEALYYVHSLLYSSMTSDSKSLENEYQRRLVKLLL

SEQ ID NO: 105 - protein, 287 aa, Yoka poxvirus
MESIIKNIKDGIYILLPYYENLPDLDLVLGKTPLPSLEYGTNYFLHISRVNDLNRMPTDMLKLFTHNIMLPENDLEKVYDILNIKSVKSYGRTIKADAIVADLSARNKLFKKEREGIKSNNYLTENNLYVSDYTMLTLDIFRPLFDIVSEKYCIVKLPTLFGRCVIDSMRIYCSIFKNVRLFKCVSDSWLKDSSIMVASDINKKNLDIFMLHIRSVTKSNIWKDSNSVQFSILKEPVDKEFINKFLEFSNKVYESLYYIHSLLYLSMTSDSKSIENEYQRRLAKALL

SEQ ID NO: 106 - protein, 287 aa, Deerpox virus
METIIKNIKDGVYTLLPFYESLPELNLSLGKSPLPSLEYGANYFLQLSRVNDLNRFPTDLLSLFTHDLMLPENDLESVYDILKIQSVKSYGKSIKADAVVADLSAKNKLFKKDRELIKSNNYLTENNLYISDYKMLTFEVFRPLFDFVSEKYCIVKMPTLFGRGIIDTMRVYCSLFKSVKMFKCTNDSWLKDSAIMVATDVYKKNMDEFMSHVRSVTKSSNWKDSNNVQFTILQESVDREFIDKFLDFSTSVYESLYYVHSLLYSSMISPNKSIENEFQKKLTKLLL

SEQ ID NO: 107 - protein, 287 aa, Swinepox virus
MDKITRNIREGIHILLPFYENLPDISLSLGKSPLPSLEYGTNYFLQLSRVNDLNRLPTDMLSLFTHDIMLPETDMEKVYDILNIKSVKSYGKSIKADAVVADLSARNRLFKKDRELIKSNNYLTDNNLYISDYKMLTFEVFRPLFDLSSEKYCIVKLPTLFGKCVIDTIRVYCSLFKSVRLFKCASDSWLKDSAIMVASDIYKKNIDIFMSHIRSVLKSQYWKDSNNVQFSILKESVDKEFINKFLEFSTSVYESLYYVHSLLYSSMISDNKSIENEYQKKLTKLLL

SEQ ID NO: 108 - protein, 287 aa, Yaba-like disease virus
MEQITKCIKEGTHTLFPFYDDLPDINLFLGKSPLPSLEYGANYFLQLSRVNDLNRLPTDLLSLFTHEIMIQENDLEKVYDILNIHSVKSYGKTIKADAVVIDLSAKNKLFKRDRELIKSNNYLTENNLYISDYKMLTFEVFRPLFEMSSEKYCIIKLPTLFGKCVIDTTRIYCSLFKSVRLFKCANDSWLKDSAIIVASNACKKNIDCFMSHVRSVTKSLNWKESNNVQFSILKDSVDKEFIDKFLNFSTKVYESLYYVHSLLYASMTSESKSIENEYQKKLTKLLL

SEQ ID NO: 109 - protein, 287 aa, Yaba monkey tumor virus
MDQIAKCIKEGTHTLFPFYDNLPDVNLFLGNSPLPSLEYGANYFLQLSRVNDLNRLPTDLLSLFTHEIMVQENDLEKVYDILNIHSVKSYGKTIKADAVVIDLSAKNKLFKKDRELIKSNNYLTENNLYISDYKMLTFEVFRPLFEMSSEKYCIIKLPTLFGRCVIDTTRVYCSLFKSVRLFKCANDSWLKDSAIIVASNACKKNIDYFMSHIRSVTKSLNWKESNNVQFSILKDSVDKEFIDKFLNFSTKVYESLYYVHSLLYSSMTSESKSIENEYQKKLTKLLL

SEQ ID NO: 110 - protein, 287 aa, Rabbit fibroma virus
MDQVTKNIKEGVHTLLPFYESLPELHLVFGKSPLPGLEYGANYFLQLSKLNDLNRLPTDLLSLFTHDLITPETDLEKVYKTLNIKSVKSYGKSTKADAIVADLSAKNRLFKKDRDLVKSNNYLTENNLYIGDYKMLTFEVFRPLFDIVSERFCIIKLPTLFGKGVIDVTRVYCSLFKSVRLIKCASDSWLKDSAIIVAEQVYKKNMDEFMTYVRHVTKSPTWKDSNNVQFSILKTSVDKEFIDKFLNFSNSVYESLYYVHSLLYASMTSERKSIENEYQKKLMKILL

SEQ ID NO: 111 - protein, 287 aa, Myxoma virus
MDQVTKHIKEGVHTLLPFYDSLPELHLVFGKSPLPGLEYGANYFLQLSKLNDLNRLPTDLLSLFTHDLITPETDLEKVYKTLHIKSVKSYGKSTKADAIVADLSAKNRLFKKDRDLVKSNNYLTENNLYIGDYKMLTFEVFRPLFDIASERFCIIKLPTLFGRGVVDVLRVYCSLFKSVRLFKCASDSWLKDSAIMVAEHVHKKNMDEFMTYIRHVTKSPTWKDSNNVQFSILKTSADKEFIDKFLNFSNAVYESLYYVHSLLYASMTSERKSIENEYQKKLMKILL

SEQ ID NO: 112 - protein, 287 aa, Sheeppox virus
MDEVIKNIKEGIYILLPFYEHLPDLNLTLGKSPLPSLEYGTNYFLQLSRVNDLNRLPTDLLSLFTHDLMIPETDLEKVYEILNIKSIKSYGKNIKADAVVADLSAKNKFFKKERDLIKSNNYLNENNLYVSDYKMLTFEVFRPLFEISVEKFCIIKLPTLFGRCIVDTLRVYCSLFKSVRLFKCASDSWLKDSAIMVASEPYKKNFDSFMTEIKKTTKSSIWKDDNNVQFNILEYPVDKEFINKFLEFSTSVYESLYYVHSLLYSSMTSENKSIENEYQKKLVKILL

SEQ ID NO: 113 - protein, 287 aa, Lumpy skin disease virus
MDDVIKNIKEGIYILLPFYEHLPDLNLTLGKSPLPSLEYGTNYFLQLSRVNDLNRLPTDLLSLFTHDLMIPETDLEKVYEILNIKSIKSYGKNIKADAVVADLSAKNKFFKKERDLIKSNNYLNENNLYVSDYKMLTFEVFRPLFEMSVEKFCIIKLPTLFGRCIVDTLRVYCSLFKSVRLFKCASDSWLKDSAIMVASEPYKKNFDSFMAEIKKTTKSSIWKDANNVQFNILEYPVDKEFINKFLEFSTSVYESLYYVHSLLYSSMTSENKSIENEYQKKLVKILL

SEQ ID NO: 114 - protein, 287 aa, Goatpox virus Pellor
MDDVIKNIKEGIYILLPFYKHLPDLNLTLGKSPLPSLEYGTNYFLQLSRVNDLNRLPTDLLSLFTHDLMIPETDLEKVYEILNIKSIKSYGKNIKADAVVADLSAKNKFFKKERDLIKSNNYLNENNLYVSDYKMLTFEVFRPLFEMSVEKFCIIKLPTLFGRCIVDTLRVYCSLFKSVRLFKCASDSWLKDSAIMVASEPYKKNFDSFMAEIKKTTKSSIWKDTNNVQFNILEYPVDKEFINKFLEFSTSVYESLYYVHSLLYSSMTSENKSIENEYQKKLVKILL

SEQ ID NO: 115 - protein, 284 aa, Cotia virus
MDSIIKDGIHVLMPFYENLPELNLTFGKSPLPSLEYGANYFLQLSKVNDLNRLPTDLFSLYTHDLIQPETDLEKIYDILDIKSVKSYGKTIKSDAIVADLSAKNRLFKKDRDLIKSNNYLTENNLFISDYKMITFEIFRPLFDISNEKYCIIKIPTLFGRTIVDTIRIYCSIFKTVRMFKCVSDSWFKDSAVMVASGLYKKNLDIFLTYIRSVIKTNNIKNYNNQQFNIVKSPTDKEFIDKFLEFSIPIYEALYYIHSLLLSSMTSKNKSIENEFQKKLTRLLL

SEQ ID NO: 116 - protein, 292 aa, Squirrelpox virus
MESAVAAVREVVRDGISMLLPFYETLPELHLCLGKNHLPSLEYGTNYFLQLSKVNDLNRMSTDMLRLFTHDIAIPETDLEKIYGVLGVKNVKSYGRGIKADAVVVDLGARNKIYKKDRDFVRSNNYLTENNLYMSDYKLLTFEVFRPVFEFSSEKYCIVKLPTAFGRGVVNVARVYCSLFRTVRLIKCASDSWLKDSFVIVASEPHAANMARFASYVASVTRSSTWKESNNVQFTILDEPVEREFIDKFLAFSARVYQALYYIHSLLYASMTSESKSIENEHQKRIMKLLAG

SEQ ID NO: 117 - protein, 295 aa, Molluscum contagiosum virus subtype
MAAPTGFAAQVHALVRDGLCADMPFYETLPELNLVFGKNHTPSLQYGANYFLQLSKVNDLNRMSTDMVNLYTHDLTAPETDLEKVYEEHGIESIKAYGKSIRADAIVADLSARNKLFKKERTFVKSNNYLKENNFYVSDYSMMTFEVFRPLFDLGSERFCIVKLPTLFGRTVANAVRVYCSLFRRVQLCKGASDSWLKDSALLVCRDAYTPNLERFLAYVRASTRSPAWREANNAPFTLLDAPVEREFLEQFLGFSNQVYMAIYYVHTLLYNSMTSESKSIENDFQRRLVRLLRS

SEQ ID NO: 118 - protein, 290 aa, Bovine papular stomatitis virus
MEATDAVRRSIREGLSVTLPTFETAPRLDLQLGAGHLPSLEYGANYFLQLSRVNDLNRMPTDMLRLYTHDLMTEERDVEKVLEAHGIASVRGVQRGGKADAVVLDLSARNKLYRKERGMIRSNNHLTENNLYVADYHAITFAVMRPLLEISQERFVVLKLPTLFGTDVVHALRVYCSLFGTVRLFKCVSDSWLKDSAVMVASDPRRQDIAKFVAHVRDRAKTASWRESLAVPFRILRDPVESEFVDRFLAFAGRVYDALYVTHSLLYESMTSESKSIENESQRKLKLLLQ

SEQ ID NO: 119 - protein, 289 aa, Pseudocowpox virus
MDAIETVRRSIREGLSVTLPTFDSTPALDLQLGAGHLPSLAYGTNYFLQCSRVNDLNRMPTEMLSLYTHDLMIDERDVEKVLEAHGITSVRSGARGKADAVVLDLSARNRLYRKERGAIRSNNHLTENNLYVADYHAITFAVMRPLLEISQERFVVLKLPTLFGTDVVHALRVYCSLFGTVRLFKCVSDSWLKDSAVMVASEPRRAAIAAFATHVRERTKAAAWRDALAVPFRILRDPVESEFVDRFVAFATRVYEALYVTHSLLYESMTSESKSIENESQRKLKLLLQ

SEQ ID NO: 120 - protein, 300 aa, Orf virus
MKTDCASNKSAMDAVEAVRRSIREGLSVTLPTFDSTPALDLQLGVGHLPSLAYGTNYFLQCSRVNDINRMPTEMLSLYTHDLMIDERDVEKVLEAHGITSVRSRARGRADAVVLDLSARNRLYRKERGAIRSNNHLTENNLYVADYHAITFAVMRPLLEITQERFVVLKLPTLFGTDVVHALRVYCSLFGTVRLFKCVSDSWLKDSAVMVASEPRRAAIAAFVTHVRERTKAAAWRDSLAVPFRVLKDPVESEFVDRFVAFASRVYEALYVTHSLLYESMTSESKSIENESQRKLKLLLQ

SEQ ID NO: 121 - protein, 289 aa, Canarypox virus
MNTDKIAEIIKNGLYITMPFYETLPEMNLVFGKNHLPTLEYGTNYFLQLSKINDINRFSTDTLALFTHDLNKESDINKLYEPYNIETVKLYGKYIQADAVVVDLSAPNKLFKKEHPYYKSNNELKENNLYICDYNMITFEVFRAIFEMSSEKICIVKVPTLFGNTIINVIRIYCSLFKNVRLYKLSADSWLKDSAIIVCQSPHTSNINKFISHVRKVTKSHTWLDSNNKNFIILHNSVEKEFIEKFLSFSYKIYEVLFYVHSLLIDSMKSEQQSLDNEHQKKLIKLLRN

SEQ ID NO: 122 - protein, 289 aa, Parapoxvirus red deer
MNIDRITAFIKNGISVRMPFYDTLPEMDLVFGKNHLPSLEYGANYFLQLSKINDINRLSTEMLALYTHDLNKESDISKLFDSYNIKTIKSYGRSIQADAVFVDLRPSNSLYKNEHPYYKSNNYLKENNLYICDYTMITFEIYRPIFELSTEKTCIIKVPTLFGKNIINAVRVYCSLFKYVKLYKLSADSWLKDSAIIVCQQPHTTNINKFITYIRKVTKSQTWVDSNNINFILIHDSVEKEFIEKFLSFSYKIYESLYYVHSLLYSSMTSDLQSLDNEYQKKLIKLLRG

SEQ ID NO: 123 - protein, 289 aa, Penguinpox virus; identical to SEQ ID NO: 122

SEQ ID NO: 124 - protein, 289 aa, Pigeonpox virus
MNIDRITSFIKNGISVRMPFYDTLPEMDLVFGKNHLPSLEYGANYFLQLSKINDINRLSTEMLALYTHDLNKESDISKLFDSYNIKTIKSYGRSIQADAVFVDLRPSNSLYKNEHPYYKSNNYLKENNLYICDYTMITFEIYRPIFELSTEKTCIIKVPTLFGKTIINAVRVYCSLFKYVKLYKLSADSWLKDSAIIVCQQPHTANINKFITYIRKVTKSQTWVDSNNINFILIHDSVEREFIEKFLSFSYKIYESLYYVHSLLYSSMTSDLQSLDNEYQKKLIKLLRG

SEQ ID NO: 125 - protein, 296 aa, Turkeypox virus
MEDNIKQQKNCDVTHIIRNGISKKLAFYESLPPMNLVFGKNHLPSLEYGANYFLQLSKINDINRLSTDMLALYTHDLNKESDIPKLYEPYNIKTIKSYGKYIQADAVVVDFSAQNMLFKKDHPFYKSNNYLKENNLYICDYKMITFEIYRPVFELLSEKICIIKVPTLFGRTIVNVLRVYCSLFKQVTICKLPSDSWLKDSAIIICQQPYSPNINKFTSYVKKVTGSQSWTDTNNRHFILIHDSIEPEFIELFLSFSYKIYEALYYVHSLLYNSMTSDAQSLDNDYQKKLIKLLRN

SEQ ID NO: 126 - protein, 289 aa, Fowlpox virus
MNTDRITAFIKNGISARMPFYDTLPDMDLVFGKNHLPSLEYGANYFLQLSKINDINRLSTEMLSLYTHDLNKESDISKLFEPYNIKTIKSYGRSIQADAVVVDLRPSNSLYKNEHPYYKSNNYLKENNLYICDYTMITFEIYRPIFELSTEKTCIIKVPTLFGKTIVNAVRVYCSLFRYVKLYKLSADSWLKDSAIIVCQQPHAANINKFITYIRKVTKSQTWLDSNNVNFILIHDSVERVFIEKFLSFSYKIYESLYYVHSLLYSSMTSDLQSLDNEYQKKLIKLLRG

SEQ ID NO: 127 - protein, 289 aa, Nile crocodilepox virus
MTEEEQIIRSGFGVTFPHYPALPSLDLVFGKNHLPSLEYGADYFLCLSKVNDLNRISTETLSLYTHGLMAAEDDLERAYASLGVKTVKTHGKTIHADAVVLDMSAYRKLYKTERAAIKSNNELNFNNLFCSNYDMLTFKVFRPLFFIGTEKYCVVKLPTLFGRTVANAVRVYCSVFKCVRLFKSPHDSWFKDSALMICSGLDAGNLARLLTYLKKATRSNAWKDENDFKNYVLVRPSVEPQFLQVYVGFANPVYRAIFLVHTYLYESINSEAKSVQNEHQEKLLKILYK

SEQ ID NO: 128 - protein, 333 aa, Ectromelia virus
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTADLLSNYALQNVMISILNPVASSLKWRCPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYCNKTFPTTKAKVLFLQQSIFRFLNIPTTSTEKVSHEPIQRKISSKDSMSKNRNSKRSVRGNK

SEQ ID NO: 129 - protein, 333 aa, Monkeypox virus
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTADLLSNYALQNVMISILNPVASSLKWRCPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYCNKTFPTTKAKILFLQQSIFRFLNIPTTSTEKVSHEPIQRKISSKDSMSKNRNSKRSVRGNK

SEQ ID NO: 130 - protein, 333 aa, Cowpox virus
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRTIKKQLHPSKIILISDVRSKRGGNEPSTADLLSNYALQNVMISILNPVASSLKWRCPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYCNKTFPTTKAKVLFLQQSIFRFLNIPTTSTEKVSHEPIQRKISSKDSVSKNRNSKRSVRGNK

SEQ ID NO: 131 - protein, 333 aa, Taterapox virus
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKHLHPSKIILISDVRSKRGGNEPSTEDLLSNYALQNVMISILNPVASSLKWRCPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYCNKTFPTTKAKVLFLQQSIFRFLNIPTTSTEKVSHEPIQRKVSSKDSVSKNRNSKRSIRGNK

SEQ ID NO: 132 - protein, 333 aa, Camelpox virus
MDVVSLDKPFMYFEEIDNELDYEPESANEVAKKLPYQGQLKLLLGELFFLSKLQRHGILDGATVVYIGSAPGTHIRYLRDHFYNLGVIIKWMLVDGRHHDPILNGLRDVTLVTRFVDEEYLRSIKKQLHPSKIILISDVRSKRGGNEPSTEDLLSNYALQNIMISILNPVASSLKWRCPFPDQWIKDFYIPHGNKMLQPFAPSYSAEMRLLSIYTGDNMRLTRVTKSDAVNYEKKMYYLNKIVRNKVVVNFDYPNQEYDYFHMYFMLRTVYCNKTCPTTKAKVLFLQQSIFRFLNIPTTSTEKVSHEPIQRKVSSKDSVSKNRNSKRSVRGNK

SEQ ID NO: 133 - protein, 333 aa, Variola virus
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTEDLLSNYALQNVMISILNPVASSLKWRCPFPDQWIKDFYIPHGNKMSQPFAPSYSAEMRLLSIYTGENMRLTRVTKSDAVNYEKKMYYLNKIVRNKVVVNFDYPNQEYDYFHMYFMLRTVYCNKTFPTTKAKVLFLQQSIFRFLNIPTTSTEKVSHEPIQCKVSSKDSVYKNRNSKRSVRGNK

SEQ ID NO: 134 - protein, 333 aa, Raccoonpox virus
MDVVSLDKPFMYFEEIDNELEYEPESANEVAKKLPYQGQLKLLLGELFFLSKLQRHGILDGATVVYIGSAPGTHIRYLRDHFYNLGVIIKWMLIDGRHHDPVLNGLRDVTIVTRFVDEEYLRTIKKQLHPSKIILISDVRSKRGGNEPSTADLLSNYALQNIMVSILNPVASSLKWRCPFPDQWIKDFYIPHGNKMLQPFAPSYSAEMRLLSIYTGENMRLTRVTSSDAINYEKKMYYLNKIVRNRVVVNFDYPNQEYDYFHMFFMLRTVYCNKTFPNTKAKVLFLQQSIFRFLNIPTTSTEKVSHEPVQRKISSKDSVSKNRNSKRSVRGNK

SEQ ID NO: 135 - protein, 333 aa, Yoka poxvirus
MDVVSMDKPFMYFEEIDGMLDYEHSSADEVAKKLPYQGQLKLLLGELFFLSKLQRHGILDGATVLYIGSAPGTHIRYLRDHFYNLGVIIKWMLIDGRHHNSILNGLRDVILITRFVDEDYLRILKKQLHPSKIILISDIRSKRRSGEPTTEDLLSNYALQNIMISILNPVASSLKWRCPFPDQWIKDFYIPHGNKMLQPFAPSYSAEMRLLSIYTSDAVRLTCVTKSDAINYEKKMYYLNKIVRNRVVVNFDYTNQEYDYFHMYYILRTIYTNKTFPTTKSKVLFLQQSIFRFLNIPTTTTEKIHYEPAQRKIPGKNIVSKNRNNTRPVRYNK

SEQ ID NO: 136 - protein, 347 aa, Deerpox virus
MIKLLKRRSKSTFKMEAISMDKPFMYFDEIDNELEYDPKSAEEKPKKLPYQGQLKLLLCELFFLSKLQRHGILDGATIIYIGSAPGTHIKYIRDHFLSMGLIIKWILIDGRKHDCILEGLRDVQLITKFVDESYIKFLKKKTFPSKIILISDVRSKRGGSEPSTNDLLSNYALQNIMVTILKPVASSLKWRCPFPDQWIKDFYIPYGNEMLQPFAPKYSAELRLISIYSGDPIKLRCITKEDALKYEKKMYYLNKVVRNKIVINFDYSNQEYDFFHMYHMLRTIYSNKPFISIKAKVLYFHQSIFKFLKIPLTYTEKINNEPTQRKISSKNTLSKNRSTKKSLRDNK

SEQ ID NO: 137 - protein, 333 aa, Yaba monkey tumor virus
MDAVSMEKPIMYLDEIDNELKYDPNSANEKNKKFPFQGQLKLLLGELFFLSKLQRHGILDGSTVLYIGSAPGTHIRYLRDHFISMGLVIKWMLIDGRHHDIILNGLRDVSLITRFVDESYIKLLKKQLYPSKIILISDIRSKRGGNEPSTEDLLSNYALQNIMVSVLQPVASSLKWRCPFPDQWLRDFYVPYGNEMLQPFAPLYSAELRLITIYSGEPIKLRCITINDAKKYEKKMFYVNKVIRNKIILNFDYPNQEYDFFHMYFMLKTVYYNKEFSSTKEKVLFFHQSIFKFLKIPIINTEKVNHEQPQCKVFGKNFMSKGGNNERSVRDNK

SEQ ID NO: 138 - protein, 338 aa, Myxoma virus
MEPVSMDKPFMYFDEIDDELEYEPESVNETPKKLPHQGQLKLLLGELFFLSKLQRHGILDGSTIVYIGSAPGTHIKYLRDHFMSMGLVIKWMLIDGRTHDPILEGLRDVILITKFVDEAYIRQLKKQLYPSRVILISDVRSKRGQKEPTTQDLLSNYSLQNIMVSVLKPAASSLKWRCPFPDQWIKDFYVPHGNEMLQPFAPSYSAEMRLLSIYSGTPIRLKCITQQDSSKYEKKMYYLNKIIRNRIIINFDYSNQEYDFFHMYHMLKTVYSNKSFTSNKSKVLHFHQSIFRFLKIPITNTEKIHHEPTQRKVPSKNTMLKSRNTKKSVRGNKQGRRT

SEQ ID NO: 139 - protein, 363 aa, Yaba-like disease virus
MIHLTTTNFFKKYINYNLIKVRLLNIQHLKMDAVSMEKPIMYLDETNSEMDYDPNSANEKNKKFPFQGQLKLLLGELFFLSKLQRHGILDGSTVLYIGSAPGTHIRYLRDHFISMGLVIRWMLIDGRQHDIILNGLRDVSLITRFVDESYIKLLKKQLHNSKIILISDIRSKRGGNEPSTEDLLANYALQNIMVSVLQPIASSLKWRCPFPDQWLRDFYIPYGNEMLQPFAPAYSAELRLITIYSGEPIKLRCITKNDAKKYEKKMFYINKVIRNKIILNFDYPNQEYDFFHMYFMLKTVYYNKEFSSVKEKVLFFHQSIFRFLKIPIINTEKVKHEQSQCKIPGKNSMFKSGNIERPIRNNK

SEQ ID NO: 140 - protein, 333 aa, Swinepox virus
MEPLSIDKPFMYFDEINNELEYDPDSANEKHKKFPYQGQLKLLLCELFFLSKLQRHGILDGSTIVYIGSAPGTHIRYLRNHFVSMGLVIRWILIDGRKHDYILEGIRDITLITKFVDENYIRQLKKQLYPSKIILISDIRSKRGTSEPTTSDLLNNYTLQNIMVSILKPVASSLKWRCPFPDQWIKDFYIPYGNELLQPFAPTYSAEMRLISIYNNEPIRLRCITKEDALKYEKKMYYLNKIIRSKIVINFDYPNQEYDVFHMYHMLKTVYTNKNFISVKDKVLFIHQSIFKFLKIPITYSEKIRYEPTQRKVSSKDTMSKDRNIKKSVLGDK

SEQ ID NO: 141 - protein, 338 aa, Rabbit fibroma virus
MEPVSMDKPFMYFDEIEDELEYEPESVNETPKKLPHQGQLKLLLGELFFLSKLQRHGILDGSTIVYIGSAPGTHIKYLRDHFVSMGLVIKWMLIDGRTHDTILEGLRDVILITKFVDEAYIRQLKKQLYPSRVILISDVRSKRGKKEPTTQDLLSNYSLQNIMVSVLKPAASSLKWRCPFPDQWIKDFYVPHGNEMLQPFAPSYSAEMRLLSIYSGTPIRLKCITQQDSLKYEKKMYYLNKIIRNRIIINFDYSNQEYDFFHMYHMLKTVYSNKSFTSNKSKVLHLHQSIFRFLKIPITNTEKIHHEPTQCKVSSKNTMLKSRNTKKPVRGNKQGRRT

SEQ ID NO: 142 - protein, 333 aa, Lumpy skin disease virus
MEAVSMDKPFMYFDEIDNELEYDPKTSEEKPKKLPYQGQLKLLLCELFFLSKLQRHGILDGCTIVYVGSAPGTHIKYLRDHFLSMGLVIRWILIDGRQHDTILNGLRDVTLITKFVDESYIRVLKKQLYQSKIVLISDVRSKRGGNEPSTFDLLSNYALQNIMVSILKPAASSLKWRCPFPDQWVKDFYIPHGNEMLQPFAPKYSAEMRLISIYSGNPIKLRCITKDDSIKYEKKMFYFNKIIRNRIIINFDYSNQEYDFYHMYNMLKTVYSNKDFSSIKSKVLFFHHSIFKFLKIPIFNTEKINYEPAQRKILSKNIMFKNRNIKKSIRYNK

SEQ ID NO: 143 - protein, 333 aa, Sheeppox virus
MEAVSMDKPFMYFDEIDNELEYDPKTSEEKPKKLPYQGQLKLLLCELFFLSKLQRHGILDGCTIVYVGSAPGTHIKYLRDHFLSMGLVIRWILIDGRQHDTILNGLRDVTLITKFVDESYIRVLKKQLYKSKIVLISDVRSKRGGNEPNTFDLLSNYALQNIMVSILKPAASSLKWRCPFPDQWVKDFYIPHGNEMLQPFAPKYSAEMRLISIYSGNPIKLRCITKDDSIKYEKKMFYFNKIIRNRIIINFDYSNQEYDFYHMYNMLKTVYSNKDFSSIKSKVLFFHHSIFKFLKIPIFNTEKINYEPTQRKILSKNIMFKNRNIKKSIRYNK

SEQ ID NO: 144 - protein, 333 aa, Goatpox virus
MEAVSMDKPFMYFDEIDNELEYDPKTSEEKPKKLPYQGQLKLLLCELFFLSKLQRHGILDGCTIVYVGSAPGTHIKYLRDHFLSMGLVIRWILIDGRQHDTILNGFRDVTLITKFVDESYIRVLKKQLYQSKIVLISDVRSKRGGNEPSTFDLLSNYALQNIMVSILKPAASSLKWRCPFPDQWVKDFYIPHGNEMLQPFAPKYSAEMRLISIYSGNPIKLRCITKDDSIKYEKKMFYFNKIIRNRIIINFDYSNQEYDFYHMYNMLKTVYSNKDFSSIKSKVLFFHHSIFKFLKIPIFNTEKINYEPSQRKILSKNIMFKNRNIKKSIRYNK

SEQ ID NO: 145 - protein, 333 aa, Cotia virus
MEPVSMENPLIYFDDIDDELEYDPNSSMEPIKKIPYQGQLKLLLGELFFLTKLQKHGILDGSTVVYIGSAPGIHIKYIRDHFLSMSVIIKWLLIDGRQHDCNLEGLRDVTVITKFVDETYIRKLQKKLYPSKIILISDIRSIRGGNEPNTYDLLNNYVLQNVMVSILKPVASSLKWRCPFPDQWVKDFYIPYGTEMLQPFAPKYSAEMRLITIYNNDPIKLRLITKKDAIKYEKKMYYFNKIVRNRIVINFDYCNQEYDFYHMYYILKTIYTNKVFTDIKSKVLYLHQSIFKFLKIPISSTEKIHYEPTQCKVSGKNIMSKNRSVKKSIRYNK

SEQ ID NO: 146 - protein, 334 aa, Squirrelpox virus
MNAEHMDRPYIYFDQLDGTRDYDSEKEASRKSERMPSQGQLKLLLGELFFLSKLQRYGLLDGSNIVYVGSAPGTHIRFLRDHFADLGVTLKWTLIDGRRHDGSLRGLRDVTLVTRFADEEYTRSLRRHLRGARVILISDVRSKRGGDEPSTEDLLRDYALQNTIVSILNPAAFSLKWRCPFPGQWVRDFYVPCGKEMLQAFAPPYSAELRILSISTGEPVKLRCINLDTASDYEKKMFFFNDVVRRRVVVNFDYPNQEYDYYHMYYLLRNVFCEKEFPSTKAKVLFLHHKIFKFLNIPLSPTERLRDEPVQRPLPSKDPVPEGGDRARPVRGDK

SEQ ID NO: 147 - protein, 337 aa, Bovine papular stomatitis virus
MEGVEMEKPLLYFDELTGERDFDAAFAEANEPAKLPAQGQLKLLVGELVFLNRLYRHGMLDGSVIVYIGSAPGTHICCLHSHFQELGVSLKWILVDGRKHDACLMGLRNVTTVTRFADEAYLRELRAELKRAKVVLISDIRSNRVNTEPTTADLLRDYALQNVMVSVLKPIASSLKWRCPFPDSWEKDFYVPCGKEMLQPFAPPFSAEMRLLSVYADTPARLRLVTLSDAVKYEKRMFYLNSVVRRRVILNFDYPNQEYDFFHMFYLLSSVVCSKEFKSAKDKVLSLQQGFFRFLRIPAISTPGLRAPDDEPAQRAVPGKNSLPKGRGKKRSVRDHK

SEQ ID NO: 148 - protein, 337 aa, Parapoxvirus red deer
MEGVEMEKPLLYFDDIAGERDFDAAFAAENEPPKMPAQGQLKLLVGELVFLNRLYKHGLLDGSVIVYVGSAPGTHICCLHSHFQELGVSLKWVLIDGRKHDSCLMGLRNVTTVTRFADEAYLRELKSSMRRSKIVLISDIRSNRVNTEPTTADLLRDYALQNVMVSVLRPIASSLKWRCPFPDSWERDFYVPCGKEMLQPFAPPFSAEMRLLTVHAETPARMRLVTLADAVRYEKRMFFLNSVVRRRVILNFDYPNQEYDFFHMFHLLSTVVCSREFKSAKDKVLSLQQSFFRFLRIPPLPTPGLRAPRDEPAQCAVPGKDPLPKGRGKKRPVRGDK

SEQ ID NO: 149 - protein, 336 aa, Orf virus
MEGVEMDKPLLYFDEIAGAREYDAAFAEKHEPPKIPGRGQMKLLVCELVFLNRLHLHGMLDGSVIVYVGSAPGRHICCLHSHFQELGVSLKWVLIDGRKHDPCLSGLRNVTTVTRFADEAYLRELRGELRRSKIVLISDIRSNRVDTEPTTADLLRDYALQNTMVSVLKPVASSLKWRCPFPDSWEKDFYVPCGKEMLQPFAPPFSAEMRLLTVYSETRPKLRLITLSDAVNYEKRMFYLNSVVRQRVILNFDYPNQEYDFFHMFCLLSSVVCSCEFKSPKEKVLSLQNRFFRFLRIPPSITLGLRQHDEPPQHAVPGQDPLPKGRGKKRPLRGGK

SEQ ID NO: 150 - protein, 342 aa, Molluscum contagiosum virus
MEAQAMERPLLYFHELTQTQEYDAEVERAARSRFPAQGQLKLLIGELFFLNKLHRREMLAGTTVVYIGSAPGGHIRYLVEHFRALGVPLRWMLLDGRSHDSRLQGLSDVTLVTRFVDERYLMRMRQALRGARVVLISDIRSRRGSEPSTEDLLYDYALQNSMLSILKPVASSLKWRCPFPDQWLHNFYVVCGKELLQPFAPPFSAELRLLSVHAGAPRLRCITLAAARDYEKKMFYLNNVIRRRIVLNFDYPNQEYDFFHMFHLLNTVLCPRSFDSPTKKVLFLQQSIFRFLGIQSPLPEKLPLPERPRKHEPAQRGVPGQDPVSEGRGRAKPVRGRQQGAP

SEQ ID NO: 151 - protein, 336 aa, Pseudocowpox virus
MEGVEMEKPLLYFDEIAGARDYDAAFAERHEPAKIPGRGQMKLLVCELVFLNRLHLHGMLDGSVIVYVGSAPGRHICCLHSHFQELGVSLKWVLIDGRKHDPCLSGLRNVTTVTRFADEAYLRELRADLRRAKIVLISDIRSNRVDTEPTTADLLRDYALQNTMVSVLKPVASSLKWRCPFPDSWEKDFYVPCGKEMLQPFAPPFSAEMRLLTVYSETRPKLRLITLSDAVNYEKRMFYLNSVVRQRVILNFDYPNQEYDFFHMFCLLSSVACSCDFKSPKEKVLSLQNRFFRFLRIPPSITLGLRRHDEPPQHAVPGQDPLPKGRGKRRPLRGDK

SEQ ID NO: 152 - protein, 302 aa, Canarypox virus
MNVIELSKPFIFYDELVHRLDYDKAIECSCKAKFQGQGQLKLLLGELYFLNTLLRNNMLYSDMVIVYIGSAPGSHIKFLYSHLESLGIRLKWILIDGRDHDSSLSTLRNVTIIKRFVDEQYLFKLHEKLKKEKVILISDIRSLRGKEPTSEDLLHDYSLQNLMISILRPIASSLKWRCPFPDQWIRDFYIPLGDEFLQPFAPSYSAEMRLLGSYTRGPIRLIRITREAAVEYEKKMFYLNNKVRKSIVLDFDYPRQEYDFFHMFYILKDLIVSESLEFTTDKQKVIFLQDSIFKSLNIKPTP

SEQ ID NO: 153 - protein, 300 aa, Turkeypox virus
MNILDAERPFMFYNELTCKQDYNKNIESSCKNKFPCQGQLKLLIGEIYFLNRLIKEDILCSNTVIIYIGSAPGNHIKFLHNYLNSINIYPKWILIDGRDHEASLEGLKDVTIVQRFVDEPYLFKLRNITKKDKVVLISDIRSLRGKEPTTEDLLHDYALQNMMISILAPVASSLKWRCPFPEQWLDDFYIPYGEEFLQPFAPTFSAEMRILGIYVKAPIRLLRINKDIALEYEKKMFYLNNIIRRSIVLDFDYPIQDYDFFHMFHILKDIVIPESLQFLTDKQKVIFLQDSIFKSLNIRK

SEQ ID NO: 154 - protein, 308 aa, Fowlpox virus
MHEGHQESFKELEMTKPYMFFNELVGEEDYNKELENSNTKFQGQGQLKLLLGELYFLNTLIKNKTLCSDTVIVYIGSAPGSHINFLYHYMDDLKIDLKWILIDGRDHDRSLESLKNVSIIHRFVDEQYLFKLRNMIRKNHKIVLISDIRSLRGKEPTSEDLLHDYALQNQMVSILKPIASSLKWRCPFPDQWIRDFYIPCGDEFLQPFAPPFSAEMRLLSCYSRAPIRLIRIDKNAAIEYEKKMFYLNTKIRPKIVLDFDYPNQKYDYFYMFYILKDIVLPTYKEFSTYKQKVIFLQEAIFNALNIKP

SEQ ID NO: 155 - protein, 308 aa, Penguinpox virus
MHEGRKDTFKELEMTKPYMFFNELVGEEDYNKALEGSNTKFQGQGQLKLLLGELYFLNILIKNKTLCSDTVIVYIGSAPGSHINFLYHYMDDLKIDLKWILIDGRDHDQSLENLKNVSIIHRFVDEQYLFKLRNMIRKNNKIVLISDIRSLRGKEPTSEDLLHDYALQNQMVSILKPIASSLKWRCPFPDQWIRDFYIPCGDEFLQPFAPPFSAEMRLLSCYSRAPIRLIRIDKNAAIEYEKKMFYLNTKIRPKIVLDFDYPNQKYDYFYMFYILKDIVLPTSKEFSTYKQKVIFLQESIFTALNIKP

SEQ ID NO: 156 - protein, 294 aa, Nile crocodilepox virus
MAGTISMPKPYLFFSDLSGEEEYSADYEQRRFRSQGQLKLLLGELYFLDQLSKAGTLSGSPTVVYIGSAPGTHIRYLRDHFAKLGYELRWVLIDGREHDASLRGLPDVELVTRFVNEAYLHRLRAKLGDRAVVLISDIRAVRDGEPRTEDMLEDYRLQNKMVEVLKPVAFSLKWRCPFPDQWTKDFVVIKGAEFLQPFRPSYSTEMRLLSLNGRPLTIRHVTLDAAKEYERKLFYLNHRVRRCTVLSFDFYNQGYDYFHAYWLLKDLSYPAVFQSEKIKAAFLLQEIFDFLGIK

SEQ ID NO: 157 - protein, 311 aa, Salmon gill poxvirus
MSANHKKFKSLTLETCPIMSFDQITKQLKWEKNMDKTVFPHKTNGQLKLLLGELLFFTEITRDTPLFNRENVNSFVVVYVGSCPGFHVPAIDYFFPGLTWELIDPTPMSVTLEKYVHRHKNRYTYTRDYADVKWAQHVVDKYPGKKIVLISDIRTSGDGEPTTQNLLDDYDLQEAIIKKLKPCAWMLKWRCPFPDSWPTTKEVKIPVGKIYVQAFAKPTSAELRIVNLTGNLTTNVVTKQEGVIYEEKMCYFNQVLRRSQITNGLYDLIFHDKLYAFEIATRIFNYAWTTHAPVLGRTCDKIYHIYTALCK

SEQ ID NO: 158 - protein, 295 aa, Melanoplus sanguinipes entomopoxvirus
MSIYMKINDFKKPNVLIFDNINNQLKYKPNNVSNKHPGQLKLLMTELQFFNNCNIDALNSKDRPIYVLYIGSGRGYHLIKLLDLYKDYNIKWYFYDPSGHCISLERMSQYVSINNDYFTEKNINEFKNKKPLLFISDIRSTDGSEPRTKNLIDDYKIQNNIVLNLRPLYSLLKFRYPFPDDFPPEIENEVYVDGIKFLQPFCGPQSTEMRIFVSEQNIILKNFSKEESILFEEKMYYYNKNYRIINKNDILIAGFILKSTNKFDNMKYIDIIKSLENSINNQIREDISFNKLDIK

SEQ ID NO: 159 - protein, 266 aa, Choristoneura biennis entomopoxvirus
MNFPLYLNNAIFKSNNKINIDKLPLIGSLKNYLMMKMFIEKYVHTQDVTIIIIGSAPGMSITEIIIEYPYINFELYDNKQHAPLLYNFNNVKIYNKLFSLYDIKKYIDKNIYVYSDLRTNSKDVNLYNDIYNQHKFILHLNPISAMYKVKLPHINTNYKYIKLPIGIDIIQPFAEHTREYRCVQFKNNYRLNYYKIDTAIDYVAKLNYYNNISLLDKTINYKYAKYILKVNNIRHHITRLLYNFNKRKPLNNKRKIFIMNMKQMLY

SEQ ID NO: 160 - protein, 258 aa, Choristoneura rosaceana entomopoxvirus
MNFPLYLNNAIFKSNNKINIDKLPLIGSLKNYLMMKLFIEKYVHTQDVTIIIIGSAPGMSITEIIVEYPYINFELYDNKQHAPLLYNFNNVKIHNKLFSLYDINKYIDKNIYVYSDLRTNSKDINLYNDIYNQHKFILHLNPISAMYKVKLPHISTNYKYIKLPIGIDIIQPFAEHTREYRCVQFKNKYRLRYYNIDTAIDYVTKLNYYNNISLLDKTINYKYAKYILKVNNIRHHITRLLYNFNKRKPLNNKRKILL

SEQ ID NO: 161 - protein, 845 aa, Artificial sequence
  Variant of the enzyme, all Cysteines substituted
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (342)..(342): Xaa can be any naturally occurring amino acid, preferably Ala, Ser and Val
  misc_feature (458)..(458): Xaa can be any naturally occurring amino acid, preferably Ala, Ser and Val
  misc_feature (582)..(582): Xaa can be any naturally occurring amino acid, preferably Ala, Ser and Val
  misc_feature (825)..(825): Xaa can be any naturally occurring amino acid, preferably Ala, Ser and Val
MDANIVSSSTIATYIDALAKNASELEQRSTAYEINNELELVFIKPPLITLTNVVNISTIQESFIRFTVTNKEGIKIRTKIPLSKVHGLDVKNVQLVDAIDNIVWEKKSLVTENRLHKEXLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSKGLYXYFTHLGYIIRYPVKRTIDSEVVVFGEAVKDKNWTVYLIKLIEPVNAISDRLEESKYVESKLVDIXDRIVFKSKKYEGPFTTTSEVVDMLSTYLPKQPEGVILFYSKGPKSNIDFKIKKENTIDQTANVVFRYMSSEPIIFGESSIFIEYKKFTNDKGFPKEYGSGKIVLYNGVNYLNNIYXLEYINTHNEVGIKSVVVPIKFIAEFLVNGEILKPRIDKTMKYINSEDYYGNQHNIIVEHLRDQSIKIGDVFNEDKLSDIGHQYAANNDKFRLNPEVSYFTNKRTRGPLGILSNYVKTLLISMYXSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKXEGLDVEDLLSYYVVYVFSKR

SEQ ID NO: 162 - protein, 844 aa, Artificial sequence
  Catalytic polypeptide variant all cysteines substituted
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (342)..(342): Xaa can be any naturally occurring amino acid, preferably Ala, Ser and Val
  misc_feature (458)..(458): Xaa can be any naturally occurring amino acid, preferably Ala, Ser and Val
  misc_feature (581)..(581): Xaa can be any naturally occurring amino acid, preferably Ala, Ser and Val
  misc_feature (824)..(824): Xaa can be any naturally occurring amino acid, preferably Ala, Ser and Val
MDANVISSSTIATYIDALAKNASELEQGSTAYEINNELELVFIKPPLITLTNVVNISTIQESFIRFTVTNKEGVKIRTKIPLSKVHGLDVKNVQLVDAIDNIVWEKKSLVTENRLHKEXLLRLSTEERHIFLDYKKYGSSIRLELVNLIQAKTKNFTIDFKLKYFLGSGAQSKSSLLHAINHPKSRPNTSLEIEFTPRNNETVPYDELIKELTTLSRHIFMASPENVILSPPINAPINTFMLPKQDIVGLDLENLYAVTKTDGIPITIRVTSKGLYXYFTHLGYIIRYPVKRIIDSEVVVFGEAVKDKNWTVYLIKLIEPVNAISDRLEESKYVESKLVDIXDRIVFKSKKYEGPFTTTSEVVDMLSTYLPKQPEGVILFYSKGPKSNIDFKIKKENTIDQTANVVFRYMSSEPIIFGESSIFIEYKKFTNDKGFPKEYGSGKIVLYNGVNYLNNIYXLEYINTHNEVGIKSVVVPIKFIAEFLVNGEILKPRIDKTMKYINSEDYYGNQHNVIVEHLRDQSIKIGDVFNEDKLSDVGHQYANNDKFRLNPEVSYFTNKRTRGPLGILSNYVKTLLISMYXSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKXEGLDVEDLLSYYVVYVFSKR

SEQ ID NO: 163 - protein, 844 aa, Artificial sequence
  Catalytic polypeptide variant all cysteines substituted
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (342)..(342): Xaa can be any naturally occurring amino acid, preferably Ala, Ser and Val
  misc_feature (458)..(458): Xaa can be any naturally occurring amino acid, preferably Ala, Ser and Val
  misc_feature (581)..(581): Xaa can be any naturally occurring amino acid, preferably Ala, Ser and Val
  misc_feature (824)..(824): Xaa can be any naturally occurring amino acid, preferably Ala, Ser and Val
MDANVVSSSTIATYIDALAKNASELKQGSTAYEINNELELVFIKPPLITLTNVVNISTIQESFIRFTVTNKEGVKIRTKIPLSKVHGLDVKNVQLVDAIDNIVWEKKSLVTENRLHKEXLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPINTFMLPKQDIVGLDLENLYAVTKTDGIPITIRVTSKGLYXYFTHLGYIIRYPVKRIIDSEVVVFGEAVKDKNWTVYLIKLIEPVNAISDRLEESKYVESKLVDIXDRIVFKSKKYEGPFTTTSEVVDMLSTYLPKQPEGVILFYSKGPKSNIDFKIKKENTIDQTANVVFRYMSSEPIIFGESSIFIEYKKFTNDKGFPKEYGSGKIVLYNGVNYLNNIYXLEYINTHNEVGIKSVVVPIKFIAEFLVNGELLKPRIDKTMKYINSEDYYGNQHNVIVEHLRDQSIKIGDIFNEDKLSDVGHQYANNDKFRLNPEVSYFTNKRTRGPLGILSNYVKTLLISMYXSKTFLDDSNKRKVLAIDFGNGADLEKYFYGEIALLVATDPDADAIARGNERYNRLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKXEGLDVEDLLSYYVVYVFSKR

SEQ ID NO: 164 - protein, 844 aa, Artificial sequence
  Catalytic polypeptide variant all cysteines substituted
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (342)..(342): Xaa can be any naturally occurring amino acid, preferably Ala, Ser and Val
  misc_feature (458)..(458): Xaa can be any naturally occurring amino acid, preferably Ala, Ser and Val
  misc_feature (581)..(581): Xaa can be any naturally occurring amino acid, preferably Ala, Ser and Val
  misc_feature (824)..(824): Xaa can be any naturally occurring amino acid, preferably Ala, Ser and Val
MDANVVSSSTIATYIDALAKNASELEQGSTAYEINNELELVFIKPPLITLTNVVNISTIQESFIRFTVTNKEGVKIRTKIPLSKVHGLDVKNVQLVDAIDNIVWEKKSLVTENRLHKEXLLRLSTEERHIFLDYKKYGSSIRLELVNLIQAKTKNFTIDFKLKYFLGSGAQSKSSLLHAINHPKSRPNTSLEIEFTPRDNEKVPYDELIKELTTLSRHIFMASPENVILSPPINPPIKTFMLPKQDIVGLDLENLYAVTKTDGIPITIRVTSKGLYXYFTHLGYIIRYPVKRIIDSEVVVFGEAVKDKNWTVYLIKLIEPVNAISDRLEESKYVESKLVDIXDRIVFKSKKYEGPFTTTSEVVDMLSTYLPKQPEGVILFYSKGPKSNIDFKIKKENTIDQTANVVFRYMSSEPIIFGESSIFIEYKKFTNDKGFPKEYGSGKIVLYNGVNYLNNIYXLEYINTHNEVGIKSVVVPIKFIAEFLVNGEILKPRIDKTMKYINSEDYYGNQHNVIVEHLRDQSIKIGDVFNEDKLSDVGHQYANNDKFRLNPEVSYFTNKRTRGPLGILSNYVKTLLISMYXSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRILVYNPSTMSTPMTEYIIKKNDIVRVFNEYGFVLVDNIDFATIIERSKKFINGASTMEDRPSTRNFFELNRGAIKXEGLDVEDLLSYYVVYVFSKR

SEQ ID NO: 165 - protein, 843 aa, Artificial sequence
  Catalytic polypeptide variant all cysteines substituted
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (341)..(341): Xaa can be any naturally occurring amino acid, preferably Ala, Ser and Val
  misc_feature (457)..(457): Xaa can be any naturally occurring amino acid, preferably Ala, Ser and Val
  misc_feature (580)..(580): Xaa can be any naturally occurring amino acid, preferably Ala, Ser and Val
  misc_feature (823)..(823): Xaa can be any naturally occurring amino acid, preferably Ala, Ser and Val
MDANIVSSSTIATYIDALAKNASELEQRSTAYEINNELELVFIKPPLITLTNVVNISTIQESFIRFTVTNKEGVKIRTKIPLSKVHGLDVKNVQLVDAIDNIVWEKKSLVTENRLHKEXLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSKGLYXYFTHLGYIIRYPVKRIIDSDVVVFGEAVKDKNWTVYLIKLIEPNAIGDRLEESKYVESKLVDIXDRIVFKSKKYEGPFTTTSEVVDMLSTYLPKQPEGVILFYSKGPKSNIDFKIKKENTIDQTTNVVFRYMSSEPIIFGESSIFIEYKKFTNDKGFPKEYGSGKIVLYNGVNYLNNIYXLEYINTHNEVGIKSVVVPIKFIAEFLVNGEILKPRIDKTMKYINSEDYYGNQHNIIVEHLRDQSIKIGDVFNEDKLSDVGHQYANNDKFRLNPEVSYFTNKRTRGPLGILSNYVKTLLISMYXSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRILVYNPSTMSTPMTEYIIKKNDIVRVFNEYGFVLVDNIDFATIIERSKKFINGASTMEDRPSTRNFFELNRGAIKXEGLDVEDLLSYYVVYVFSKR

SEQ ID NO: 166 - protein, 844 aa, Artificial sequence
  Catalytic polypeptide variant all cysteines substituted
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (342)..(342): Xaa can be any naturally occurring amino acid, preferably Ala, Ser and Val
  misc_feature (458)..(458): Xaa can be any naturally occurring amino acid, preferably Ala, Ser and Val
  misc_feature (581)..(581): Xaa can be any naturally occurring amino acid, preferably Ala, Ser and Val
  misc_feature (824)..(824): Xaa can be any naturally occurring amino acid, preferably Ala, Ser and Val
MDANVVSSSTIATYIDALAKNASELEQGSTAYEINNELELVFIKPPLITLTNVVNISTIQESFIRFTVTNKEGVKIRTKIPLSKVHGLDVKNVQLVDAIDNIVWEKKSLVTENRLHKAXLLRLSTEERHIFLDYKKYGSSIRLELVNLIQAKTKNFTIDFKLKYFLGSGAQSKSSLLHAINHPKSRPNTSLEIEFTPRDNETVPYDELIKELTTFSRHIFMASPENVILSPPINAPIKTFMLPKQDIVGMDLENLYAVTKTDGIPITIRVTSKGLYXYFTHLGYIIRYPVKRIIDSEVVVFGEAVKDKNWTVYLIKLIEPVNAISDRLEESKYVESKLVDIXDRIVFKSKKYEGPFTTTSEVVDMLSTYLPKQPEGVILFYSKGPKSNIDFKIKKENTIDQTVNVVFRYMSSEPIIFGESSIFIEYKKFTNDKGFPKEYGSGKIVLYNGVNYLNNIYXLEYINTHNEVGIKSVVVPIKFIAEFLVNGEILKPRIDKTMKYINSEDYYGNQHNVIVEHLRDQSIKIGDVFNEDKLSDVGHQYANNDKFRLNPEVSYFTNKRTRGPLGILSNYVKTLLISMYXSKTFLDDSNKRKVLAIDFENGADLEKYFYGEIALLVATDPDADAIARGNERYNKLNSGIKTKYYKFDYIQETIRSNTFVSSVREVFYFGKFNIIDWQFAIHYSFHPRHYATIMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKXEGLDVEDLLSYYVVYVFSKR

SEQ ID NO: 167 - protein, 842 aa, Artificial sequence
  Catalytic polypeptide variant all cysteines substituted
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (340)..(340): Xaa can be any naturally occurring amino acid, preferably Ala, Ser and Val
  misc_feature (456)..(456): Xaa can be any naturally occurring amino acid, preferably Ala, Ser and Val
  misc_feature (579)..(579): Xaa can be any naturally occurring amino acid, preferably Ala, Ser and Val
  misc_feature (822)..(822): Xaa can be any naturally occurring amino acid, preferably Ala, Ser and Val
MDAKVATSSTIATYIESLAKKSSELDNHSTAYEINNELELVFIKPPLIALTNVVSISTIQESFIRFTVTNREGVKIRTKIPLSKVHGLDVKNVQLVEAIDNIVWEKKTLVTETRLHKEXLLRLSTEERHIFLDYKKYGSSIRLELVNLIQAKTKNFTIDFKLKYFLGSGAQSKSSLLHAINHPKSRPNTSLEIEFTPREDEKVPYDELIKELTTVTRHIFMASPENVILSPPISSPIKTFMLPKQDIVGLDLENLYAVTKTDGVPVTIRITSKGLYXYFTHLGYIIKYPVKRAIDTDVVVFGEAIKDKNWTVYLIKLIEPVIDDRLEESNYVDSKLVGIXDRVVFKSKKYEGPFTTSSEVVDMLSTYLPKQPEGVILFYSKGSKSNVDFKIKNENTVDQAVNIVFRYMSSEPIIFGESSIFVEYKRFSNDKGFPKEYGSGKIILYNGVDYLNNIYXLTFANTHDDVGIKSIVVPIKFIAEFQVNGEILKPRIDKTMKYINSEDYYGNQHNVVVEHLRDQSIKIGNVFNEDKLSDIGHQYANNDKFRLNPEVSYFTNKRTRGPLGILSNYVKTLLISMYXSKTFLDDSNKRKVLAIDFGNGADLEKYFYGEIALLVATDPDADAIARGNERYNKLNSGIKTKYYKFDYIQETIRSETFVSSVREVFYFGKFNIIDWQFAIHYSFHPRHYATVMNNLSELTASGGKVLITTMDGDKLSKLTDKKTFIIHKNLPSSENYMSVEKIADDRILVYNPSTMSTPMTEYIIKKNDIVRVFNEYGFVLVDNVDFATIIERSKKFINGASKMEDRPSTRNFFELNRGAIKXEGLDVDDLLSYYVVYVFSKR

SEQ ID NO: 168 - protein, 839 aa, Artificial sequence
  Catalytic polypeptide variant all cysteines substituted
  misc_feature (173)..(173): Xaa can be any naturally occurring amino acid, preferably Ala, Ser and Val
  misc_feature (276)..(276): Xaa can be any naturally occurring amino acid, preferably Ala, Ser and Val
  misc_feature (340)..(340): Xaa can be any naturally occurring amino acid, preferably Ala, Ser and Val
  misc_feature (454)..(454): Xaa can be any naturally occurring amino acid, preferably Ala, Ser and Val
  misc_feature (576)..(576): Xaa can be any naturally occurring amino acid, preferably Ala, Ser and Val
  misc_feature (819)..(819): Xaa can be any naturally occurring amino acid, preferably Ala, Ser and Val
MDDKLLTSSIARYIEDLAKHSTELKNQSATYDVNNELELIFTNPPLITLTNVFNISTLQESFIRFTVTNKDGVKIRTKIPLSKVHGLDIKNSQLVDVIENIVWEKKTLINEIVYNKEVILRLSTEEKYIFLDYKKYGSSIKLELVNLIQSRTKNFIIDFKIKYFLGSGAQSKXSLLHSINHPKSKPNMSLEIEFISMDNKNVQYDKLLNELTTISRNIFMASPENVYLSPIIKIPVNTFMLHKQDIPALELENLYAVSKTDGIPVTVKLKSTGIYXYFGHIGYIIRYPIKKNLDTDIILFGEAIKDKNQWIIYLIKLLEPVIHDRLDERNYIESRLDDVXDRIIFKVKKYEGPFTTSSEIIDMLSNYLPKQNEGVILFYSKGNKNDYKIKKENTVDQMVNIVFRYMSSEPIIFGDNSIFIEYKKFSSDKGFPKENGSGKIIIYSDVNYLNNIYXIEFKNIYLDAGLKSVVVPIKFIAEFSTNGDIIKPRIGKTMRYINEEYYGNPYNVVVEHLRDQKISVNDIFNEDKLSEIGQQYVTNDKFRLNPEVSYFTNKRTRGPLGILSNYVKTLLISMYXSKTFLDNSNKRKVLAIDFGNGADLEKYFYGEIALLVATDPDADAISRGNDRYNKLNSGIKTKYYKFDYIKETIRSETYISSIREVFYFGKFDIIDWQFAIHYSFHPRHYSTVMRNLSELTASGGKVLITTMDGDKLSLLTSKKTFIIHKNLPDSENYMAIEKIADDRIMVYNPSTMSTPMTEYIIKKNDITRVFNEYGFVLIDNVDFATIINRSKKFINGVSKLEERPSTKNFFELNRGAIKXDGIDVDDLLSYYVVYVFSKR

SEQ ID NO: 169 - protein, 840 aa, Artificial sequence
  Catalytic polypeptide variant all cysteines substituted
  misc_feature (98)..(98): Xaa can be any naturally occurring amino acid, preferably Ala, Ser and Val
  misc_feature (119)..(119): Xaa can be any naturally occurring amino acid, preferably Ala, Ser and Val
  misc_feature (215)..(215): Xaa can be any naturally occurring amino acid, preferably Ala, Ser and Val
  misc_feature (276)..(276): Xaa can be any naturally occurring amino acid, preferably Ala, Ser and Val
  misc_feature (340)..(340): Xaa can be any naturally occurring amino acid, preferably Ala, Ser and Val
  misc_feature (456)..(456): Xaa can be any naturally occurring amino acid, preferably Ala, Ser and Val
  misc_feature (477)..(477): Xaa can be any naturally occurring amino acid, preferably Ala, Ser and Val
  misc_feature (479)..(479): Xaa can be any naturally occurring amino acid, preferably Ala, Ser and Val
  misc_feature (577)..(577): Xaa can be any naturally occurring amino acid, preferably Ala, Ser and Val
  misc_feature (625)..(625): Xaa can be any naturally occurring amino acid, preferably Ala, Ser and Val
MDDTFLTTSVYNYIYSLLDIYNDVPQPVHLDDVNHEVEMIFTNPSIVTLSNLINISSTQESYILFTLTRKDEHTKIRTKIPMSKIHGIDIKNIQLVNXIDNIIWEKKIRVKENIIDDWXIVQYSTEEKYIFLDYKKFTSSIKLELVNLIQARIKNIVIDFKIKYFLGSGAQSKSSLLHVLNHPKSKPKTSLEIEIVTRDIKIDTSVLSNEIHTIXKILFMSDTKNIYLYSRFKNPIKTHMLKKQDITSIDLENLYITTKTDGVGVLVKINKNGIYXYFQHLMYTIRYTLIKVLDNDVTIYGEAIKQNNVWNIYLIKMIQPVLVDRFNERDYVVSYLNNIXDRIVFKVKKYEGPFNTHSEIIDTLSTYLPLQNEGVILFYSKGSKSNIDYKIKHDNTTDNMINIIYRYMSSEPVIFGENSTFIEYKKFSDDKGFPKENGTGKLILSTDVKYLNNIYXIEFNNIYNDIGIKKVILPIKXIXEFSITGEFIKPRIDKTMKYLYEEYYGNQYHVVVDHIRDQRIHINDIFDENKLSDIGKDYANDKYRLNPEISYFTNKRVRGPLGILSNYIKTLLISLYXSKTFLDNSNKRKVLAIDFGNGADLEKYFFGEVALLVATDPDKDAIRRXMERYNKLNSGIKSKYYKFDYIRETIRSETYVSNIREVFFFGKFDIIDWQFAIHYSFHPKHYATIMNNLSELTASGGKILITTMDGDKLSMLTDKKTFIIHKNLPTTENYMSIEKISDEQILVYNPSSMSKPMEEYIVKKYDIVRIFSEYGFVLIDYINFDTVIDRSKHFINNVSKMEERQSTKNFFELNRVALKYDGLDIDELLKYYVVYVFSKR

SEQ ID NO: 170 - protein, 840 aa, Artificial sequence
  Catalytic polypeptide variant all cysteines substituted
  misc_feature (19)..(19): Xaa can be any naturally occurring amino acid, preferably Ala, Ser and Val
  misc_feature (119)..(119): Xaa can be any naturally occurring amino acid, preferably Ala, Ser and Val
  misc_feature (276)..(276): Xaa can be any naturally occurring amino acid, preferably Ala, Ser and Val
  misc_feature (284)..(284): Xaa can be any naturally occurring amino acid, preferably Ala, Ser and Val
  misc_feature (456)..(456): Xaa can be any naturally occurring amino acid, preferably Ala, Ser and Val
  misc_feature (577)..(577): Xaa can be any naturally occurring amino acid, preferably Ala, Ser and Val
  misc_feature (625)..(625): Xaa can be any naturally occurring amino acid, preferably Ala, Ser and Val
  misc_feature (797)..(797): Xaa can be any naturally occurring amino acid, preferably Ala, Ser and Val
MDDNNLKLSLSDYINKLIXVFKTIKYPLPTEDVNNEVELVFIRPPLITLGNVLNISSVQESFIMFTVGNKEKKEKIRTNVPLSKVHGLDIKNVQLVESVNNIIWEKKTLLSEYKVNDNXLIRHSIEEKHVFLDYKKYISSIKLELVNLIQAKIKNVKVDFKLKYFLGSGAQAKSSLLHVLNHPRSKPSPSLEFEIVNTDININENELFNELHALFRSIFMNLPENVFLVPNFKNPLKTYMLKKQDISGISLDNLYATTKTDGIGAIVKIKQNKIYXHFSHINYXIKYLANRTMENEIVIYGEALKYNGKWNIYLIKLINPNLENRIMEKDFVDEELKGISDKIIFKVKKYEGPFSSHSEIIDLLTFYLPMQKEGVILFYTEGKNSSFDYKIKNDNTTDHMVNLVYRYMSSEPVIFGESNTFVEFKKFSDEKGFPKDFGTGKIILTESVKYLNNIYXLEFSNVYDDVGIKNVVVPVKFISEFSSKGNIIKPRIDKTMKYMYSDYYGNQHNVVLDHVMDQNIKIEDIFNEEKLSNIGKIYANDKYRLNPETSYFTNKRTRGPLGILSNYVKTLLISLYXSKTFLDNPNKKKVLAVDFGNGADLEKYFYGEISLLVATDPDFKAIERXNERYTKLNSGIKSKYYKFNYIQETIRSNSYVSSVREVFFFGKFDIIDWQFAIHYSFHKKHYSTIMKNLSELTASGGKVLITTMDGDKLHDLKDKKTFIIHKSLPSSENYMSVEKINTEQVLVYNPSSMSKPMEEYIVRKTDIIRVFSEYGFELIDNVDFSTIINRSKKFINXVSKMEERQSTKNFFELNRDALKFNSLDVEELLSYYVVYVFSKR

SEQ ID NO: 171 - protein, 843 aa, Artificial sequence
  Catalytic polypeptide variant all cysteines substituted
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (341)..(341): Xaa can be any naturally occurring amino acid, preferably Ala, Ser and Val
  misc_feature (457)..(457): Xaa can be any naturally occurring amino acid, preferably Ala, Ser and Val
  misc_feature (580)..(580): Xaa can be any naturally occurring amino acid, preferably Ala, Ser and Val
  misc_feature (628)..(628): Xaa can be any naturally occurring amino acid, preferably Ala, Ser and Val
  misc_feature (800)..(800): Xaa can be any naturally occurring amino acid, preferably Ala, Ser and Val
MDDKIFDKSLNDYINELIGVYESIPKPKSLDDINHEVEIVFIQPPLITLNNVLNISSKQESYILFSLTNKEDRVKIRSYLPMSKVYGLDLKNIQLVDSIDNIIWEKKTLITEHIVDKHXMVRYSTEEKHIFLDYRKYISAIRLELVNLIQLKIKNILIDFKIKYFLGSGAQAKSSLLHVLNHPKSKPNVSLEFEIISGNDYKIDKDIIFNEISTLFRNIFMGNPKNIFMTPEQKNPIKTRMIKKQDITGLELDNLYITTKTDGVGSLIKINKNGIFXYFSHLNYSIRYNLLKPIDKQIVLYGEALKHGKMWNIFLIKLIEPILDDRIKEKDFINDELDNVXDRLEFKVKKYEGPFTTHSEIVDLLSSYLPIQSEGAILFYSKGNKSNIDYKIKNDNTTDHMANIIYRYMSSEPVIFGENQTFIEYKKFSDDKGFPKEFGNGKIVLSEKIRYLNNIYXITFNDLYKDVGLHTVTVPIKFIAEFTTNGEFIKPRLDKTMKYFYKNYYGNQYNVVLEHLHDQHIKINDIFDENKLSNLGEEYAKDKDKNRLNPETSYFTNKRTRGPLGILSNYIKTLLISLYXSKTFLDNTNKRKVLAIDFGNGADLEKYFYGEISLLVASDPDQDAINRXIERYNKLNSGIKSKYYKFDYIKETIRSEKYVSNIREVFFFGKFDIVDWQFAIHYSFHPKHYSTVMKNLAELTASGGKVLITTMDGDKLSQLTDKKTFIIHKNLPNSENYMSVEKLNDEKILVYNPSSMSKPMEEYIIRRSDIIRIFSEYGFVLIDYVHFDTVIDRSKKFINXVSKMEERQSTKNFFELNRDALKYEKIDIESLLQYYVVYVFSKR

SEQ ID NO: 172 - protein, 835 aa, Artificial sequence
  Catalytic polypeptide variant all cysteines substituted
  misc_feature (272)..(272): Xaa can be any naturally occurring amino acid, preferably Ala, Ser and Val
  misc_feature (336)..(336): Xaa can be any naturally occurring amino acid, preferably Ala, Ser and Val
  misc_feature (451)..(451): Xaa can be any naturally occurring amino acid, preferably Ala, Ser and Val
  misc_feature (572)..(572): Xaa can be any naturally occurring amino acid, preferably Ala, Ser and Val
  misc_feature (620)..(620): Xaa can be any naturally occurring amino acid, preferably Ala, Ser and Val
  misc_feature (776)..(776): Xaa can be any naturally occurring amino acid, preferably Ala, Ser and Val
MDESKKRGTDYIEELIRVYEDVPNPVQTDDINHEVELTFIHPPIIALSTLIHVATSQESYILFTVTNKGVKIRNRINLSKIHGLDLKNIQLVDSIDNIIWEKKTLVKEHKVDPAAVVKYSTEEKYIFLDYKKYLSSIKLELVNVVQAKVKHVTVDFKFKYFLGSGAQAKSSLLHVLNHPKSKPNPSLEFEIVTTDEKIDSVSLRKELVALFKLVFMTSPDNIILDGILKPPVQTVMLKKNDLPGIDLTNLYVTTKTDGVGVLITVTNKGIYXFFTHLQYTIRYDTTFKSDNPVTLYGEAIKQNNVWHVYLIKLMTPKLSDRFKEKDYVEEHLKDIXDRMIFKVKKYEGPFESHSEIIDLLTSYLPSQPEGVVLFYSDQRNQPDYKIKLDNTTDHMVNIIYRYMSSEPVIFGENSTFLEYKKFSDDKGFPKDYGTGKLALTDNVRYLNNIYXMEFANAYEDVGIKNVVVPIKFISEFSATGEFIKPRIDKTFRYLYMEYYGNPYQVVVTHIRDQSIKIGDVFDEDRLSDVGQHYANDKYRLNPDVSYFTNKRTRGPLGILSNYVKTLLISLYXSKTFLDNSNKRKVLAIDFGNGADLEKYFYGEISSLVATDPDKEAITRXIERYNSLNSGIKSKYYKFDYIQETIRSTTYVSSVREVFFFGKFDLVDWQFAIHYSFHPKHYTTVMNNLAELTASGGKVLITTMDGDLLSQLTDKKTFVIHKNLPSSENYMSVEKIHEDQILVYNPSSMSRPMQEYIIKRANLTKIFSEYGFELIDXVHFDTVVERSKRFITGVSKMEERKSTKNFFELNREALKYEGTDIGDLLRYYIVYVFSKR

SEQ ID NO: 173 - protein, 840 aa, Artificial sequence
  Catalytic polypeptide variant all cysteines substituted
  misc_feature (19)..(19): Xaa can be any naturally occurring amino acid, preferably Ala, Ser and Val
  misc_feature (119)..(119): Xaa can be any naturally occurring amino acid, preferably Ala, Ser and Val
  misc_feature (276)..(276): Xaa can be any naturally occurring amino acid, preferably Ala, Ser and Val
  misc_feature (284)..(284): Xaa can be any naturally occurring amino acid, preferably Ala, Ser and Val
  misc_feature (456)..(456): Xaa can be any naturally occurring amino acid, preferably Ala, Ser and Val
  misc_feature (486)..(486): Xaa can be any naturally occurring amino acid, preferably Ala, Ser and Val
  misc_feature (577)..(577): Xaa can be any naturally occurring amino acid, preferably Ala, Ser and Val
  misc_feature (625)..(625): Xaa can be any naturally occurring amino acid, preferably Ala, Ser and Val
  misc_feature (797)..(797): Xaa can be any naturally occurring amino acid, preferably Ala, Ser and Val
MDDDNLKLSLLDYIKKLIXVFKTIKNPLPTEDVNNEVELIFIQPPLITLGNLLNISSVQESFIMFTVGNKGKKVKIRTKVPLSKVHGLDIKNIQLVDSVDNIIWEKKTLVYEDVINDYXLIRHSTEEKHVFLDYKKYISSIKLELVNLIQTRIKHIQVDFKLKYFLGSGAQAKSSLLHVLNHPKSKPTPSLEFEIVNTDIKIDENELLNEMYTLFRSIFMNLPENVFLVPSFKNPLKTYMLKKQDIAGLHLENLYATTKTDGIGTIVKIKQNEIYXHFSHINYXIKYLANRTIENEILLYGEALKHKGKWSIYLIKLMKPKLENRIKEKDFVDENLKEISEKIIFKVKKYEGPFSSHSEIIDLLTFYLPVQKEGVILFYIEGKNSNSDYKIKNDNTTDHMINVVYRYMSSEPVIFGDSNTFIEFKKFSDEKGFPKDFGTGKIILTESIKYLNNIYXLEFSNVYEDVGIKKVVVPVKFISEFSSKGXLLKPRIDKTMKYMYSDYYGNQYNIVMDHIMDQNIKIEDIFNEEKLSDIGKNYADDKYRLNPEVSYFTNKRTRGPLGILSNYIKTLLISLYXSKTFLDNSNKKKVLAIDFGNGADLEKYFYGEISLLVATDPDSKAIERXNERYTKLNSGIKSKYYKFNYIQETIRSSSYVSSVREVFFFGKFDIIDWQFAIHYSFHKKHYSTIMKNLTELTASGGKVLITTMDGDKLYNLKDKKTFIIHKSLPSSENYMSVEKINSEQILVYNPSSMSKPMEEYIVKKLDIVRIFSEYGFELIDNVNFDTVINRSKKFINXVSKMEERQSTKNFFELNREALKFDVLDVEELLSYYVVYVFSKR

SEQ ID NO: 174 - protein, 842 aa, Artificial sequence
  Catalytic polypeptide variant all cysteines substituted
  misc_feature (73)..(73): Xaa can be any naturally occurring amino acid, preferably Ala, Ser and Val
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (458)..(458): Xaa can be any naturally occurring amino acid, preferably Ala, Ser and Val
  misc_feature (579)..(579): Xaa can be any naturally occurring amino acid, preferably Ala, Ser and Val
  misc_feature (627)..(627): Xaa can be any naturally occurring amino acid, preferably Ala, Ser and Val
  misc_feature (783)..(783): Xaa can be any naturally occurring amino acid, preferably Ala, Ser and Val
MDERDLENSLSDYIDKIVEIYDEIPNPTLSNDVNHEVELVFIQPPIITLSNVYNISSVTESYILFTVTNKEEXIKIRTKVPMSKIHGLDLKNLQLVDLIDDIIWEKKTLIKEKKIDKHXIIRYSSEERHVFLDYKRYTSSIKLELVNLVQTKVKNIVVDFKIKYFLGSGAQAKSSLLHVLNHPKSKPTPTLEFEIITREKKNSRDILLNELHILFKNIFMADPKNVFLPTVIFTSPVKTIMLKKQEIHNIELDKLYITTKTDGVGTLIKINKNGIFXYFTHLNYIIKYNLLRKFDDTVILYGEAIKQNKKWFIYLIKLLKPELSNRFKERDFLIEKLTSDISDRIVFKTKKYEGPYETHSEVIDLLSTYLPLQTEGVILFYSEGNKSKIDYKIKHDNTTDHMINAVYRYMSSEPVIFGDKYTFIEFKKFSDERGFPKEHGTSKIILGNNIKYLNNIYXIEFKNIYKDVGIKNIVLPIKFISEFSFNGNFLKPRLDKTMKYFYKEYYGNQYQVVLEHIRDQELRINDIFDENKLSDLGKKYVDDEFRLNPEVSYFTNKRTRGPLGILSNYIKTLLISLYXSKTFLDNPNKRKVLAVDFGNGADLEKYFYGEIALLVATDPDKDAISRXIERYNKLNSGIKSKYYKLDYIQETIRSSVYVSKIREVFFFGKFDIVDWNFAIHYSFHPKHYSTIMKNLSELTAPGGNVLITTMDGDKLSYLLERKVFIIHKNLPSSENYMSVEKISDDKILVYNPSSMSKPMEEYIVKKSDIKRVFSEYGFVLIDXVNFDTVINRSKKFINYVSKMEERQSTKNFFELNREALKYDNIDIEELLNYYVVYVFSKR

SEQ ID NO: 175 - protein, 836 aa, Artificial sequence
  Catalytic polypeptide variant all cysteines substituted
  misc_feature (273)..(273): Xaa can be any naturally occurring amino acid, preferably Ala, Ser and Val
  misc_feature (337)..(337): Xaa can be any naturally occurring amino acid, preferably Ala, Ser and Val
  misc_feature (452)..(452): Xaa can be any naturally occurring amino acid, preferably Ala, Ser and Val
  misc_feature (573)..(573): Xaa can be any naturally occurring amino acid, preferably Ala, Ser and Val
  misc_feature (621)..(621): Xaa can be any naturally occurring amino acid, preferably Ala, Ser and Val
  misc_feature (777)..(777): Xaa can be any naturally occurring amino acid, preferably Ala, Ser and Val
MDDSKKKRGTDYIEELILLYEDVPNPVQTDDMNHEVELTFIQPPVITLSTLLPFATSQESYILFTVTNKGVKIRNRINLSKIHGLDLKNIQLVDSIDNIIWEKKTLVKEHKIDSVALVKYSTEEKYIFLDYKKYLSAIKLELVNVVQVKVKHVTVDFKFKYFLGSGAQAKSSLLHVLNHPKSKPNPSLEFEIITTDEKIDSASLRKELIALFKLVFMASPSNIILDVVFKNPVQTILLKKNELPGIDLTNLYVTTKTDGVGVLITVTNKGIYXFFTHLQYTIRYDTTFESNESVTLYGEAVKQNNVWQIYLIKLITPKVSDRFKEKEYVEERLQNIXDRMTFKVKKYEGPFESHSEIIDLLTTYLPSQPEGVVLFYSDQRNQPDYKIKLDNTTDHMINIIYRYMSSEPVIFGENSTFLEYKKFSDDKGFPKDYGTGKLMLTDNVRYLNNIYXIAFTNVYEDVGIKNVVVPIKFISEFSATGELIKPRIDKTFKYLYKEYYGNQYQIVVAHIRDQNIKIGDVLDEDKLSDVGQHYANDKYRLNPDVSYFTNKRTRGPLGILSNYVKTLLISLYXSKTFLDNSNKRKVLAIDFGNGADLEKYFYGEISSLVATDPDKEAIGRXIERYNSLNSGIKSKYYKFDYIQETIRSVTYVSSVREVFFFGKFDLVDWQFAIHYSFHPKHYATVMNNLTELTASGGKVLITTMDGDLLSQLTDKKTFVIHKNLPSSENYMSVEKIHEDQILVYNPSSMSRPMQEYIVKRVNLTKIFSEYGFELIDXVHFDTIIERSKRFINSVSKMEERKSTKNFFELNREALKHEGTDIDDLLRYYIVYVFSKR

SEQ ID NO: 176 - protein, 842 aa, Artificial sequence
  Catalytic polypeptide variant all cysteines substituted
  misc_feature (73)..(73): Xaa can be any naturally occurring amino acid, preferably Ala, Ser and Val
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (458)..(458): Xaa can be any naturally occurring amino acid, preferably Ala, Ser and Val
  misc_feature (579)..(579): Xaa can be any naturally occurring amino acid, preferably Ala, Ser and Val
  misc_feature (627)..(627): Xaa can be any naturally occurring amino acid, preferably Ala, Ser and Val
  misc_feature (783)..(783): Xaa can be any naturally occurring amino acid, preferably Ala, Ser and Val
MDERDLENSLSDYINKIVEIYDEIPNPTLSNDVNHEVELVFIQPPIITLSNVYNISSVTESYILFTVTNKGEXIKIRTKVPMSKIHGLDLKNLQLVDLIDDIIWEKKTLIKEKKIDKHXIIRYSSEERHVFLDYKRYTSSIKLELVNLVQTKVKNIVVDFKIKYFLGSGAQAKSSLLHVLNHPKSKPTPTLEFEIITREKKNSRDILLDELHILFKNIFMADPKNVFLPTVIFTSPVKTIMLKKQEIHNIELDKLYITTKTDGVGTLIKINKNGIFXYFTHLNYIIKYNLLRKFDDTVILYGEAIKQNQKWFIYLIKLLKPELSNRFKERDFLIEKLTSDISDRIVFKTKKYEGPYETHSEVIDLLSTYLPLQTEGVILFYSEGNKSKIDYKIKHDNTTDHMINAVYRYMSSEPVIFGDKYTFIEFKKFSDERGFPKEHGTSKIILGDNIKYLNNIYXIEFKNIYNDVGLKNIVLPIKFISEFSFNGDFLKPRLDKTMKYFYKEYYGNQYQVVLEHIRDQELRINDIFDENKLSDLGKKYVDDEFRLNPEVSYFTNKRTRGPLGILSNYIKTLLISLYXSKTFLDNPNKRKVLAVDFGNGADLEKYFYGEIALLVATDPDKDAISRXIERYNKLNSGIKSKYYKLDYIRETIRSSVYVSKIREVFFFGKFDIVDWNFAIHYSFHPKHYSTIMKNLSELTAPGGNVLITTMDGDKLSYLSERKVFIIHKNLPSSENYMSVEKISDDKILVYNPSSMSKPMEEYIVKKSDIKRVFSEYGFVLIDXVNFDTVINRSKKFINYVSKMEERQSTKNFFELNREALKYDNIDIEELLNYYVVYVFSKR

SEQ ID NO: 177 - protein, 842 aa, Artificial sequence
  Catalytic polypeptide variant all cysteines substituted
  misc_feature (73)..(73): Xaa can be any naturally occurring amino acid, preferably Ala, Ser and Val
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (458)..(458): Xaa can be any naturally occurring amino acid, preferably Ala, Ser and Val
  misc_feature (579)..(579): Xaa can be any naturally occurring amino acid, preferably Ala, Ser and Val
  misc_feature (627)..(627): Xaa can be any naturally occurring amino acid, preferably Ala, Ser and Val
  misc_feature (783)..(783): Xaa can be any naturally occurring amino acid, preferably Ala, Ser and Val
MDERNLENSLSDYINKIVEIYDEIPNPILSNDVNHEVELVFIQPPIITLSNVYNISSVTESYILFTVTNKGEXIKIRTKVPMSKIHGLDLKNLQLVDLIDDIIWEKKTLIKEKKIDKHXIIRYSSEERHVFLDYKRYTSSIKLELVNLVQTKVKNIVVDFKIKYFLGSGAQAKSSLLHVLNHPKSKPTPTLEFEIITREKKNSSDMLLNELHILFKNIFMADPKNVFLPTVIFTSPVKTIMLKKQEIHNIELDKLYITTKTDGVGTLIKINKNGIFXYFTHLNYIIKYNLSRKFDDTVILYGEAIKQNQKWFIYLIKLLKPELSNRFKERDFLIEKLTSDISDRIVFKTKKYEGPYATHSEVIDLLSTYLPLQTEGVILFYSEGNKSKIDYKIKHDNTTDHMINAVYRYMSSEPVIFGDKYTFIEFKKFSDERGFPKENGTSKIILGNNIKYLNNIYXIEFKNIYKDVGLKNIVLPIKFISEFSFNGNFLKPRLDKTMKYFYKEYYGNQYQVVLEHIRDQELRINDIFDENKLSDLGKKYVDDEFRLNPEVSYFTNKRTRGPLGILSNYIKTLLISLYXSKTFLDNPNKRKVLAVDFGNGADLEKYFYGEIALLVATDPDKDAISRXIERYNKLNSGIKSKYYKLDYIRETIRSSVYVSKIREVFFFGKFDIVDWNFAIHYSFHPKHYSTIMKNLSELTAPGGNVLITTMDGDKLSYLSERKVFIIHKNLPSSENYMSVEKISDDKILVYNPSSMSKPMEEYIVKKSDIKRVFSEYGFVLIDXVNFDTVINRSKKFINYVSKMEERQSTKNFFELNREALKYDNIDIEELLNYYVVYVFSKR

SEQ ID NO: 178 - protein, 841 aa, Artificial sequence
  Catalytic polypeptide variant all cysteines substituted
  misc_feature (118)..(118): Xaa can be any naturally occurring amino acid, preferably Ala, Ser and Val
  misc_feature (275)..(275): Xaa can be any naturally occurring amino acid, preferably Ala, Ser and Val
  misc_feature (341)..(341): Xaa can be any naturally occurring amino acid, preferably Ala, Ser and Val
  misc_feature (455)..(455): Xaa can be any naturally occurring amino acid, preferably Ala, Ser and Val
  misc_feature (577)..(577): Xaa can be any naturally occurring amino acid, preferably Ala, Ser and Val
  misc_feature (626)..(626): Xaa can be any naturally occurring amino acid, preferably Ala, Ser and Val
  misc_feature (701)..(701): Xaa can be any naturally occurring amino acid, preferably Ala, Ser and Val
MDATPEHPLSEFLGELARAAAEVAAEPAAVDVHHELELVFIRPPLAALGAIVGLATEQTSYVLFTVSSRDGVKLRVKLPMSRVHGLDAKNVQLVDAVDDIIWEKKTLVSQRELAGGAXLLRHSTEERHIFVDFKKFGSSIKLELVNLIRISARNIVTDFKFKYFLGSGTQAKSSLLHALNHPKSRPNATLEFEVLRRDADATAEQLAEELTTVARAIFMAHPDNVFLVPPVRDPIRTHMLKKQNILSLELQGLYATSKTDGVAATVRVDASGVYXFFNHLGYVIRYPALREVEEPVVLFGEAVRSAEDRRWHVHLIKLVAPTLESRLEEHEFVERRMEGLXDRVVFRAKRFMGPFASVSELTDMLTEELPKQEEGVVLFYASGEAPDMKIKKDNTVDQAVNVTFRYMSSEPVIFGDKATFVEYKRFSDERGFPREHGSGRIVIGDSVAYLNNVYXLSFAGTHDTVGLSRVVLPVKFVAEFSHDGTLLRPRVDKTMRYLYSSGYYGNQHSVVVDHLRDQALSVGDVFVGEKLAEAGRNLANDEFRLNPDTSYFVKNRTRGPLGILSNYVKTLLISLYXSKTFLDNANRRKVLAIDFGNGADLEKYFYGEVALLVATDPDARAIERGXERYNRLNSGIKSRYYKFDYVQETIRSDTFVSSIRKVFYFGRFDIVDWQFAIHYSFHPRHYATVMRNLSELTASGXKVLITTMDGDFLSSITSTRSFVINRALQESENFISFERIDDEQVLVYNPSTMAKPMAEYIVKKEALVRVFGEYGFVLIDHVDFATVVRRGRAFVEGVARMETRQSTRNFFDLNRVALADMRDTDVEELLQYYVVYVFSKR

SEQ ID NO: 179 - protein, 854 aa, Artificial sequence
  Catalytic polypeptide variant all cysteines substituted
  misc_feature (132)..(132): Xaa can be any naturally occurring amino acid, preferably Ala, Ser and Val
  misc_feature (198)..(198): Xaa can be any naturally occurring amino acid, preferably Ala, Ser and Val
  misc_feature (289)..(289): Xaa can be any naturally occurring amino acid, preferably Ala, Ser and Val
  misc_feature (451)..(451): Xaa can be any naturally occurring amino acid, preferably Ala, Ser and Val
  misc_feature (470)..(470): Xaa can be any naturally occurring amino acid, preferably Ala, Ser and Val
  misc_feature (515)..(515): Xaa can be any naturally occurring amino acid, preferably Ala, Ser and Val
  misc_feature (591)..(591): Xaa can be any naturally occurring amino acid, preferably Ala, Ser and Val
  misc_feature (639)..(639): Xaa can be any naturally occurring amino acid, preferably Ala, Ser and Val
  misc_feature (795)..(795): Xaa can be any naturally occurring amino acid, preferably Ala, Ser and Val
MEKKHYLFNKYIMEEDNIFDTSVYKYINELIKVYKNIKPHSPTDDIYDEVEAVIINPPLITLTNVFNISTKIESYMLFTVTNKEDGFKIRSRLNMSNIYGLDIKNVQLIDSIDNIIWEKKKLITEEKVDENXIIRHSTEEKHIFLDFKKYNSSIKIEFVNLIQSKIKNILVDFKLKYFLGSGAQGKSSLLHVLNYPKXKPNMSLEFEILHKDKPINETDLYNELVTIYRNIFMGYPKNIFLKRQLSYPIHTYMLKKQDISGISLDDLYITNKTDGVGTYITILDSGIYXYFSHLNYTIRYDINKKINTTTVKLYGEGLKYDGKWSIYLIKLITPSFDDRFKEKEFVSNELLNISDKIQIKTKKYYGPFTTHSELIDTIIEYLPNQQEGLVLFYKTGENSNKDYKIKNDNTTDHMINAIYRYMSSEPVIFGEDNTFVEYKKFSDEKGFPKEXGTGKLILSDNVKYLNNIYXIEFYNIYNTVGLNNVVLPIKFISEFSSNGNFLRPRIDKTAKYIKXDYFGNQYNVVLEHIMDQQLKITDIFDDNKLSDIGQKYNIEKNRLNPDISYFTNKRTRGPLGILSNYIKTLLISLYXSKTFLDNSNKRKVLAVDFGNGADLQKYFYGEISLLVASDPDKDAINRXIERYNKLNSGIKSKYYKFDYINDTIRSESYISNIRKVFFFGKFDIIDWQFAIHYSFHKKYYSVVMNNLSELTASGGKVLITTMDGDKLSEITGIKKFIINKKLPESENYMSIEKISNETILVYNPSSMSKPMEEYIIKYKDISRIFLEYGFELIDXVHFNTIIDRSNRFINNVSKMEQRESTKNFFDLNREVLNDNIDDINELLEYYIVYVFSKR

SEQ ID NO: 180 - protein, 950 aa, Artificial sequence
  Catalytic polypeptide variant all cysteines substituted
  misc_feature (223)..(223): Xaa can be any naturally occurring amino acid, preferably Ala, Ser and Val
  misc_feature (381)..(381): Xaa can be any naturally occurring amino acid, preferably Ala, Ser and Val
  misc_feature (447)..(447): Xaa can be any naturally occurring amino acid, preferably Ala, Ser and Val
  misc_feature (563)..(563): Xaa can be any naturally occurring amino acid, preferably Ala, Ser and Val
  misc_feature (686)..(686): Xaa can be any naturally occurring amino acid, preferably Ala, Ser and Val
  misc_feature (733)..(733): Xaa can be any naturally occurring amino acid, preferably Ala, Ser and Val
  misc_feature (810)..(810): Xaa can be any naturally occurring amino acid, preferably Ala, Ser and Val
  misc_feature (930)..(930): Xaa can be any naturally occurring amino acid, preferably Ala, Ser and Val
MDEHLERPLEYYFRELVAEFERAVRRGDSAVKKNSPKRSRAPQSLTNSKGNAGGKAEPEPELENGNTGAGAPKARTRAAPEAQAAHPPVSAHKSRPRAHAAFTSRARTEEREPGPALEPVHGPAPAPAADTTSDVHHEVELIFVRPPLVTLSHLLGIATRQESYVLFSLTSLEREGVKLRTRLPLARVHGLDMKNNQLVEAIDSILWEKKTRVAQRDFPEAHXLLRHSTEEQYVFLDFRNFNSAIRLELVNHVQARVRNIVVDFKLKYFLGSGAQTRNSLLAVLNYPKFRPSVTLEFEVLLRDPAAFSPRELLRELLVLGNLLFMAPAEHVFLMPAPKEPLTTHMLKKQDLLTLELRDLYVTGKTDGVPTFVHVAGASVYXFFSHLGYAIRYPARVTLPAPVALFGEAVRDAQSKQLTVYLIKLMAPALEDRLEEREFVLRRLQGLXERVAFQAKQYEGPFATSSELTDALAQMLAAQPEGVVLFYARGSRSGADLKLKRDNTVDQAVNVIYRYMSSEPVIFGDGVTFLEFKRFSNDKGFPKEFGTGRLVLAEGARYLNNIYXLEFADTHSGVGLRKVVVPVKFVGEFSHDGRLLRPRLAKTMLYLSNANYYGNQASVVLEHLQDQRLRVGDVFREDKLADAGKAAAVADAHRLNPDTAYFTKRRVRGPLGVLSNYVKTLLISLYXSKTFFDNPNKRKVLAVDFGNGADLEKYFYGEIALLIATDPDARAIEXGRERYNKLNSGNKSKYYKFDYIQETIRSESFVASVREVFYFGKFDIVDWQFAIHYSFHPRHYATVMRNLAELTASGXRVLITTVDGDFLATLTRKRSFVIHRDLPEPENYISFEKLDSEHVLVYNPSTMAKPMVEYIVRKQALVRVFGEYGFVLVDHVDFHTVVHRSRAFIDGVAQMESRTSTKNFFELNRAALQSXRGLDVEELLQYYVVYVFAKR

SEQ ID NO: 181 - protein, 849 aa, Artificial sequence
  Catalytic polypeptide variant all cysteines substituted
  misc_feature (124)..(124): Xaa can be any naturally occurring amino acid, preferably Ala, Ser and Val
  misc_feature (281)..(281): Xaa can be any naturally occurring amino acid, preferably Ala, Ser and Val
  misc_feature (306)..(306): Xaa can be any naturally occurring amino acid, preferably Ala, Ser and Val
  misc_feature (347)..(347): Xaa can be any naturally occurring amino acid, preferably Ala, Ser and Val
  misc_feature (463)..(463): Xaa can be any naturally occurring amino acid, preferably Ala, Ser and Val
  misc_feature (585)..(585): Xaa can be any naturally occurring amino acid, preferably Ala, Ser and Val
  misc_feature (709)..(709): Xaa can be any naturally occurring amino acid, preferably Ala, Ser and Val
  misc_feature (840)..(840): Xaa can be any naturally occurring amino acid, preferably Ala, Ser and Val
MSSPDTGPVPGPSLDEMLVALAAKAASVDRGPAEDEVHHEVELVLVNPPLSTLAVALRLASETESFILFTVTALAKEEGKLRARMPLSRVVGLDVKNVQLVNAIDSIVWERKALVEETELRAEXLLRHSTERRHLFVDFKKYMSAIRVELVNRVRVRSREVQADFKFKYFLGSGAQSKSSLLHALNHPKMRPSPTLEFEVVPSEAAVDEAAVLAELRAMAKALFMAPAEAVFLEPPPRMPVKTHMLPKQEIPSLDLQGLYAVSKTDGVPAAVTVDESGVYXAFAHLGYTIRYAAARAPAKQYRLRXEAVRHVGERVWSMYIILVEEPAGVDRVAAAEAAAEELRGVXARVEFKAKRVEGPFYSTSELVDFLAGALKAEPEGVVLFYASGERAARDFKVKRDNSVDQTANVVFRYMSSEPIVFGEGSTFLEFKRYSNDNGFPKEYGSGRIFLREDVIYHNNIYXVEFARTHADVGLRSVVVPVKFVGEFSSEGALLRPRLDKTALYFRNASYYGNQHSVVLEHARDQLLAVGDVLDESRMAAVGHTLANDAFRLNPDTPYFTNRRTRGPLGVLSNYVKTLMISLYXSKTFLNNPERRKVLAVDFGNGADLEKYFFGEIVSMVATDPDARAIERAMERYNRLNAGIKSRYYKFNYIQETIRSDTYVESIRQVMYFGRFNIVDWQMAIHYSFHPRHFATVMRNLRELTAPGXKVLVTTMDGDYLSTLAGKVSFVINKNLQESENFMSLERVAEDQVLVYTPSTMAQPMAEYIVRRADIVRLFADSGFDLVDHADFETVIRRSRRFVEGVSRLETRPSTKNFFELNRTALAEMEGTDVAALLKXYVLYVFSKR

SEQ ID NO: 182 - protein, 842 aa, Artificial sequence
  Catalytic polypeptide variant all cysteines substituted
  misc_feature (116)..(116): Xaa can be any naturally occurring amino acid, preferably Ala, Ser and Val
  misc_feature (274)..(274): Xaa can be any naturally occurring amino acid, preferably Ala, Ser and Val
  misc_feature (293)..(293): Xaa can be any naturally occurring amino acid, preferably Ala, Ser and Val
  misc_feature (299)..(299): Xaa can be any naturally occurring amino acid, preferably Ala, Ser and Val
  misc_feature (337)..(337): Xaa can be any naturally occurring amino acid, preferably Ala, Ser and Val
  misc_feature (340)..(340): Xaa can be any naturally occurring amino acid, preferably Ala, Ser and Val
  misc_feature (456)..(456): Xaa can be any naturally occurring amino acid, preferably Ala, Ser and Val
  misc_feature (578)..(578): Xaa can be any naturally occurring amino acid, preferably Ala, Ser and Val
  misc_feature (702)..(702): Xaa can be any naturally occurring amino acid, preferably Ala, Ser and Val
MSAPSLDELLVALAAKAAAVDRGSPADEVHHEVELVLVHPPLATLATALRLASETESFILFTVTALAKEEGKLRARMPLSRVVGLDVKNVQLVNSIDTIVWERKSLVEETELHPGXLLRHSTERRHLFVDFKKYLSAIRVELVNLVRVRSKEVIADFKFKYFLGSGAQAKSALLHALNHPKIRPSATLEFEVVPSGETLDEASVLAELRAMAKALFMAGSDSVFLTPALSAPPVRTVMLQKQEIPALELEGLYSVSKTDGVLAAVAVTEDGVRXSFGHLGYTIRYPLAKAPKXEYRLWXEAVRPVGERVWAMHVLFVEEPQGSDRIADAAAAAEALXGVXARVEFKSKRVDGPFSATSELVEHISSAIKTEPEGIVLFYASGERSKLDFKVKRDNTVDQTTNVTFRYMSSEPIVFGDGATFLEFKRFSNDKGFPKDYGTGRIFLRDDVIYHNNIYXIEFTKTHREVGLASVVVPVKFISEFSQEGYLLRPRPEKTMKYLRNPSYYGNQHSVVLEHARDQLLSVMDVFDENRMAAVGHTLANDAFRLNPDTPYFTNRRTRGPLGVLSNYVKTLMISLYXSKTFLNNPEKRKVLAVDFGNGADLEKYFFGEIASMVATDPDARAIERAMDRYNRLNAGLKSRYYKFNYIQETIRSETYVESIRQVMYFGRFNLVDWQMAIHYSFHARHFATVMRNLRELTAPGXKVLITTMDGDYLATLTGKVSFVINRNLQESENFMSVERVAEDQVMVYTPSTMAQPMTEYIVRREDIVKLFADNGFDLIDHANFETVIRRSRRFVEGVSRLETRPSTKNFFELNRNALEEMDRTDVAELLKRYVLYVFSKR

SEQ ID NO: 183 - protein, 841 aa, Artificial sequence
  Catalytic polypeptide variant all cysteines substituted
  misc_feature (8)..(8): Xaa can be any naturally occurring amino acid, preferably Ala, Ser and Val
  misc_feature (116)..(116): Xaa can be any naturally occurring amino acid, preferably Ala, Ser and Val
  misc_feature (273)..(273): Xaa can be any naturally occurring amino acid, preferably Ala, Ser and Val
  misc_feature (298)..(298): Xaa can be any naturally occurring amino acid, preferably Ala, Ser and Val
  misc_feature (339)..(339): Xaa can be any naturally occurring amino acid, preferably Ala, Ser and Val
  misc_feature (455)..(455): Xaa can be any naturally occurring amino acid, preferably Ala, Ser and Val
  misc_feature (496)..(496): Xaa can be any naturally occurring amino acid, preferably Ala, Ser and Val
  misc_feature (577)..(577): Xaa can be any naturally occurring amino acid, preferably Ala, Ser and Val
  misc_feature (701)..(701): Xaa can be any naturally occurring amino acid, preferably Ala, Ser and Val
MDAPSLDXMLAALAAKAASVDRGAPEDEVHHEVELVLVDPPLSTLAATLRLASETESFILFTVTALAKEEGKLRARVPMSRVVGLDVKNVQLVNAIDSIVWERKALVEETALQEGXLLRHSTERRHLFVDYKKYLSAIRVELVNRVRVRSKEVVVDFKFKYFLGSGAQAKSSLLHALNHPKVRPSPTLEFEVVPAGEAVDEAAVLTELRAVAKALFMAPTDAVFLLPPAEMPVRTLMLQKQEIPALDLDGLFAVSKTDGVSASVRVDENGVFXAFSHLAYTIRYPLAREVQGRYRLWXEAVRPVGERVWSMFVLVVEEPAGDDRVAAVAGAVEALRGVXARVEFKPKRVDGPFSATSELVEHIKSALQTEPEGVVLFYARGEKSKRDLKVKRDNTVDQTTNVMFRYMSSEPIVFGEGSTFLEFKRYSNDRGFPKEYGAGRIFLREDVVYHNNIYXIEFTKTHLEVGLRSVVVPVKFIGEFSQEGYLLRPRLAKTEXYFRNPSFYGNQHSVVLEHTRDQLLSVGDVFDESRMAAVGQTLANDAFRLNPDTPYFTNRRTRGPLGVLSNYVKTLMISLYXSKTFLNNAERRKVLAVDFGNGADLEKYFFGEIASMVATDPDARAIERAMERYNRLNAGLKSRYYKFNYIQETIRSETYVESIRQVMYFGRFNIVDWQMAIHYSFHPRHFATVMRNLRELTAPGXKVLITTMDGDFLSTLSEKTSFVINRNLQESENFMSIERVADDQVMVYAPSTMAQPMTEYIVRRADIVKLFADNGFDLVDHANFETVIRRSRRFVEGVSRLETRPSTKNFFELNRNALTEMDSTDVAALLKIYVLYVFSKR

SEQ ID NO: 184 - protein, 841 aa, Artificial sequence
  Catalytic polypeptide variant all cysteines substituted
  misc_feature (8)..(8): Xaa can be any naturally occurring amino acid, preferably Ala, Ser and Val
  misc_feature (116)..(116): Xaa can be any naturally occurring amino acid, preferably Ala, Ser and Val
  misc_feature (273)..(273): Xaa can be any naturally occurring amino acid, preferably Ala, Ser and Val
  misc_feature (298)..(298): Xaa can be any naturally occurring amino acid, preferably Ala, Ser and Val
  misc_feature (339)..(339): Xaa can be any naturally occurring amino acid, preferably Ala, Ser and Val
  misc_feature (455)..(455): Xaa can be any naturally occurring amino acid, preferably Ala, Ser and Val
  misc_feature (577)..(577): Xaa can be any naturally occurring amino acid, preferably Ala, Ser and Val
  misc_feature (701)..(701): Xaa can be any naturally occurring amino acid, preferably Ala, Ser and Val
MDAPSLDXMLAALAAKAAAVDRGAPEDEVHHEVELVLVNPPLSTLAATLRLASETESFILFTVTALAKEEGKLRARVPMSRVVGLDVKNVQLVNAIDSIVWERKALVEETALQEGXLLRHSTERRHLFVDYKKYLSAIRVELVNRVRVRSKEVVADFKFKYFLGSGAQAKSSLLHALNHPKVRPAATLEFEVVPAGEAVDEAAVLAELRAVAKALFMAPTDAVFLTPPADMPVRTLMLQKQEIPALELEGLFAVSKTDGVSASVRVDAGGVFXAFSHLGYTIRYPLAREVKGVFRLWXEAVRPVGERVWSLFVLFVEEPAGEDRVAAVAAAVEALRGVXARVEFKPKRVDGPFSATSELVEHIKGALQTEPEGVVLFYASGEKAKRDLKVKRDNTVDQTTNVMFRYMSSEPIVFGEGSTFLEFKRYSNDRGFPKEYGAGRIFLREDVVYHNNIYXIEFTKTHLEVGLRSVVVPVKFIGEFSQEGYLLRPRLAKTELYFRNPSFYGNQHSVVLEHTRDQLLSVGDVFDESRMAAVGQTLANDAFRLNPDTPYFTSRRTRGPLGVLSNYVKTLMISLYXSKTFLNNAERRKVLAVDFGNGADLEKYFFGEIASMVATDPDARAIERAMERYNRLNAGLKSRYYKFNYIQETIRSETYVESIRQVMYFGRFNIVDWQMAIHYSFHPRHFATVMRNLRELTAPGXKVLITTMDGDFLSTLTEKTSFVINRNLQESENFMSLERVAEDQVMVYAPSTMAQPMTEYIVRRADIVKLFADNGFDLVDHANFETVIRRSRRFVEGVSRLETRPSTKNFFELNRNALAEMDSTDVTALLKIYVLYVFSKR

SEQ ID NO: 185 - protein, 848 aa, Artificial sequence
  Variant of the enzyme, all Cysteines substituted
  misc_feature (123)..(123): Xaa can be any naturally occurring amino acid, preferably Ala, Ser and Val
  misc_feature (184)..(184): Xaa can be any naturally occurring amino acid, preferably Ala, Ser and Val
  misc_feature (218)..(218): Xaa can be any naturally occurring amino acid, preferably Ala, Ser and Val
  misc_feature (235)..(235): Xaa can be any naturally occurring amino acid, preferably Ala, Ser and Val
  misc_feature (282)..(282): Xaa can be any naturally occurring amino acid, preferably Ala, Ser and Val
  misc_feature (343)..(343): Xaa can be any naturally occurring amino acid, preferably Ala, Ser and Val
  misc_feature (406)..(406): Xaa can be any naturally occurring amino acid, preferably Ala, Ser and Val
  misc_feature (462)..(462): Xaa can be any naturally occurring amino acid, preferably Ala, Ser and Val
  misc_feature (584)..(584): Xaa can be any naturally occurring amino acid, preferably Ala, Ser and Val
  misc_feature (708)..(708): Xaa can be any naturally occurring amino acid, preferably Ala, Ser and Val
  misc_feature (789)..(789): Xaa can be any naturally occurring amino acid, preferably Ala, Ser and Val
  misc_feature (828)..(828): Xaa can be any naturally occurring amino acid, preferably Ala, Ser and Val
MDKYISRKPLSFYFEELVNMFMESVNNAEIDDSKHHEIELILFKPPIITLTNLYYIASSMESYIEFTMLPINKPNTKFRNRMSLSKIHGLDVKNNQLVENIDNIIWEQKTLIKKKDIADNSSXVIRYSIEEKTLFVDYKKYNSSIKLELVNLIRTRLRNIVIDFKMKYFLGSGAQSASSSSLLXALNHPKNKPSLILEFEIMIQDKTVTRNMLLDELXMVANALFLSEPRHVRLXPYLQPKLKTYLLKKQELINIDTDNLYITGKTDGIFSYVYIYHRSIFXYFNHLGYIKDYDISVDVEEPIYLYAEMRKENNIIYFTVIKVLLPELDDRLAELEFVNSNLXNLHERLVFSTKQFEGPFESTSGLVDGIEEMLKKEREGVILFYSKGNDSMLDYKIKKDNTIDQXVNIIYRYMSSEPIVYNDKGSFIEYKKYSNDKGFPKEFGTGKLVIGNGVDYINNIYXLEFTNINPATGIDKIILPIKFISEFSHNDELIQPRIDKTMKYLYEHSYYGNQLSVIMEHISDQKLKLGDIFEEEKLAEVAHLQLKDSMRLNPEGQYFLTNRVRGALGVLSNYVKTLMISMYXSKAYLDDHNKRKVLAIDFGNGADLEKYFYGEIALMVATDPDDNAIETGKKRYNKLNSGDKSKYYKFDYIKETIRSGSYVSSIRQVFYFGRFSLVDWQFAIHYSFNPKHYNTIMSNLRELTASGXKILISTMDGDYIDTLKEKKKFVIHKLLPESENYLSIEKIDDDQILVYNPSSMTKPMAEYIVRKNTLIRVFREYGFQLLDVXNFKTIINRNIDFVEGVSRLENRGSTKNFFELNRKALSEXAGTDVLELLGYYVVYVFSKV

SEQ ID NO: 186 - protein, 846 aa, Artificial sequence
  Catalytic polypeptide variant all cysteines substituted
  misc_feature (121)..(121): Xaa can be any naturally occurring amino acid, preferably Ala, Ser and Val
  misc_feature (234)..(234): Xaa can be any naturally occurring amino acid, preferably Ala, Ser and Val
  misc_feature (281)..(281): Xaa can be any naturally occurring amino acid, preferably Ala, Ser and Val
  misc_feature (354)..(354): Xaa can be any naturally occurring amino acid, preferably Ala, Ser and Val
  misc_feature (386)..(386): Xaa can be any naturally occurring amino acid, preferably Ala, Ser and Val
  misc_feature (405)..(405): Xaa can be any naturally occurring amino acid, preferably Ala, Ser and Val
  misc_feature (461)..(461): Xaa can be any naturally occurring amino acid, preferably Ala, Ser and Val
  misc_feature (583)..(583): Xaa can be any naturally occurring amino acid, preferably Ala, Ser and Val
  misc_feature (707)..(707): Xaa can be any naturally occurring amino acid, preferably Ala, Ser and Val
  misc_feature (787)..(787): Xaa can be any naturally occurring amino acid, preferably Ala, Ser and Val
  misc_feature (826)..(826): Xaa can be any naturally occurring amino acid, preferably Ala, Ser and Val
MDNYILEKPLGSHFEELVDTFFEAIRNVSEVDKSKHHEVEMQIFKPSIITLSNLYNISTTTESYIEFSMMPIDKKNTKYRNRIPLSKIHGLDIKNSQLVENLDGFIWEEKTLISEKRVSEXTNIRIRHSVEQKTLFVDYKRRNGSIRLELVSVVRATLRNIVVDFKIKYFLGSGAQSASSLLYALNNPKNKPNLYLEFEISTSDKNISKQLLLNELNTIGNALFLSKVDKIRLXPRIKLVLKTYLLKKQEIINLNIENLYITSKTDGVFTYVLLQNKSIYXYFSHLGYIKEYTANREIDEKVYLYAEMRKENGILYFTVIKVLNPRMKNRLDELKFVNKNLQNINDRLVFVTKXYEGPFDSTSDLVFAIEEMLKSEHEGVIIFYSXGEESSLDYKIKKDNTIDQXVNVIYRYMSSEPVVFSDNGPFIEYKRYSDDKDFPKEFATGKLSLGNDVKYLNNIYXIEFTNLPEHTGVEKIIVPIKFIAEFSFNDKMIQPRIDKTMRYLYTENYYGNQLSVIIDHLNDQKINIGDVFEEDKLAEVAHKQLKDSLRLNPEGNYFIANKKRSALGVLSNYVKTLLISLYXSKAYLDDHSKRKVLAIDFGNGADLEKYFYGEIALMVATDPDEMAIETGKKRYNNLNSRDKSKYYKFNYIQETIRSPTYVDSIREVLYFGKFSIVDWQFAIHYSFHPIHYSTIMKNLYELTESGXKVLISTMDGDYLDTLKDKKKFIIYKSPETENYLSVEKIDNDKILVYNPSSMTKPMAEYIVRKDTLVRVFKEYQFSLIDNXSFKTIIDRSINFVKGVSRLETRDSTKNFLELNRNALEDXEGTDVLELLDHYMIYVFSKN

SEQ ID NO: 187 - protein, 852 aa, Artificial sequence
  Catalytic polypeptide variant all cysteines substituted
  misc_feature (12)..(12): Xaa can be any naturally occurring amino acid, preferably Ala, Ser and Val
  misc_feature (185)..(185): Xaa can be any naturally occurring amino acid, preferably Ala, Ser and Val
  misc_feature (236)..(236): Xaa can be any naturally occurring amino acid, preferably Ala, Ser and Val
  misc_feature (257)..(257): Xaa can be any naturally occurring amino acid, preferably Ala, Ser and Val
  misc_feature (283)..(283): Xaa can be any naturally occurring amino acid, preferably Ala, Ser and Val
  misc_feature (328)..(328): Xaa can be any naturally occurring amino acid, preferably Ala, Ser and Val
  misc_feature (356)..(356): Xaa can be any naturally occurring amino acid, preferably Ala, Ser and Val
  misc_feature (463)..(463): Xaa can be any naturally occurring amino acid, preferably Ala, Ser and Val
  misc_feature (472)..(472): Xaa can be any naturally occurring amino acid, preferably Ala, Ser and Val
  misc_feature (587)..(587): Xaa can be any naturally occurring amino acid, preferably Ala, Ser and Val
  misc_feature (711)..(711): Xaa can be any naturally occurring amino acid, preferably Ala, Ser and Val
  misc_feature (792)..(792): Xaa can be any naturally occurring amino acid, preferably Ala, Ser and Val
  misc_feature (831)..(831): Xaa can be any naturally occurring amino acid, preferably Ala, Ser and Val
MDKYISKKPLSXYFEELVDTFISVVNDIDKVNESKHHEVELILFKPPIITLTNLYNMATATESYIEFTMLPVDKPNTKFRNRIPLSKIHGLDVKNNQLVESLDGFIWEEKSLLLKKDISDNSSAVIRHSVEEKTLFVDYKRRNASIKLELVSLVRAKLRNIVIDFKMKYFLGSGAQSANSSSLLXALNHPKNKPSLYIEFEIMTQDKNISKKKLLEELNMSASALFLSQPKYIRLXPSINPILRTHLLKKQDIINLXTEDLYITSKTDGIFSHIYIEKKSIFXYFGHLGYIKEYTASRELEEPIYLYAEMRKEESILYLTVIKVVKPXMEDRLSELEFVKNNLTSIHDRLVFVTKXYDGPFESSSDLVASIEELLKTEQEGIILFYSKGENSTTDYKVKKDNTIDQTVNVIYRYMSSEPIVFNDKGSFLEYKRYSNDKGFPKEFSTGKLDLGEGVEYVNNIYXIEIKKLNPXTGITNLVLPIKFIAEFSHNDELIQPRIDKTMKYLYENSYYGNQLSVIMDHLNDQKLRIGDVFEEEKLADVAAAHIKLKDSMRLNPDGNYFLSSRVRGALGVLSNFVKTLLISLYXSKTYLDNHSKRKVLAIDFGNGADLEKYFYGEIALMVATDPDDNAIETGKKRYNERNAGDKSKYYKFNYIKETIRSETYVSSIRQVLYFEKFNLVDWQFAIHYSFHPKHYSTIMTNLHELTESGXKVLITTMDGDYLDTLKEKKKFIIRRLLPETENYLSIEKIDDDKVLVYNPSSMSKPMAEYIVRRETLIRVFRDYKFKLIDSXSFKTIIDRNISFINGVSRLESRGSTKNFFDLNRKALEEXDDTDVLELLSHYMVYVFSKEV

SEQ ID NO: 188 - protein, 851 aa, Artificial sequence
  Catalytic polypeptide variant all cysteines substituted
  misc_feature (12)..(12): Xaa can be any naturally occurring amino acid, preferably Ala, Ser and Val
  misc_feature (185)..(185): Xaa can be any naturally occurring amino acid, preferably Ala, Ser and Val
  misc_feature (236)..(236): Xaa can be any naturally occurring amino acid, preferably Ala, Ser and Val
  misc_feature (283)..(283): Xaa can be any naturally occurring amino acid, preferably Ala, Ser and Val
  misc_feature (328)..(328): Xaa can be any naturally occurring amino acid, preferably Ala, Ser and Val
  misc_feature (356)..(356): Xaa can be any naturally occurring amino acid, preferably Ala, Ser and Val
  misc_feature (407)..(407): Xaa can be any naturally occurring amino acid, preferably Ala, Ser and Val
  misc_feature (463)..(463): Xaa can be any naturally occurring amino acid, preferably Ala, Ser and Val
  misc_feature (472)..(472): Xaa can be any naturally occurring amino acid, preferably Ala, Ser and Val
  misc_feature (586)..(586): Xaa can be any naturally occurring amino acid, preferably Ala, Ser and Val
  misc_feature (710)..(710): Xaa can be any naturally occurring amino acid, preferably Ala, Ser and Val
  misc_feature (791)..(791): Xaa can be any naturally occurring amino acid, preferably Ala, Ser and Val
  misc_feature (830)..(830): Xaa can be any naturally occurring amino acid, preferably Ala, Ser and Val
MDKYISKTPLSXYFEELVDTFISVVNSINKVDESKHHEVELILFKPPIITLTNLYNMATTTESYIEFTMLPVDKPNTKFRNRIPLSKIHGLDVKNNQLVESLDGFIWEEKSLLLKKDISDNSSAIIKYSIEEKTLFVDYKRRNASIKLELVSVVRAKLRNIVIDFKMKYFLGSGAQSANSSSLLXALNHPKNKPSLYIEFEIMMQDKNISKKKLLEELNMSASALFLSHPKYIRLXPSINPILRTHLLKKQDIININTDDLYITSKTDGIFSHVYIEKKSIFXYFSHLGYIKEYTASREIEETIYLYAEMRKEESILYLTVIKVLKPXMEDRLSELAFVKNHLTGIHDRLVFVTKXYDGPFESSSDLVVSIEEMLKTEQEGIILFYSKGEDSTTDYKVKKDNTIDQXVNVIYRYMSSEPIVFNDKGSFLEYKRYSNDKGFPKEFSTGKLDLNGSVEYINNIYXIEIKHLNPXTGITNLVLPIKFIAEFSHNDELIQPRIDKTMKYLYESGYYGNQLSVIMDHLNDQKLRIGDVFEEEKLADIAAHMKLKDSMRLNPDGNYFLSNRVRGALGILSNFVKTLLISLYXSKTYLDNHSKRKVLAIDFGNGADLEKYFYGEIALMVATDPDDNAIETGKKRYNERNAGDKSKYYKFNYIKETIRSETYVSSIRQVLYFEKFSLVDWQFAIHYSFHPKHYSTIMTNLQELTESGXKVLITTMDGDYLDTLKEKKKFIIRKLLPETENYLSIEKIDDDKVLVYNPSSMSKPMAEYIVRRDTLIRVFREYKFKLIDSXNFKTIIDRNISFINGVSRLESRGSTKNFFELNRKALEEXNDTDVLELLSHYMVYVFSKEV

SEQ ID NO: 189 - protein, 848 aa, Artificial sequence
  Catalytic polypeptide variant all cysteines substituted
  misc_feature (217)..(217): Xaa can be any naturally occurring amino acid, preferably Ala, Ser and Val
  misc_feature (280)..(280): Xaa can be any naturally occurring amino acid, preferably Ala, Ser and Val
  misc_feature (369)..(369): Xaa can be any naturally occurring amino acid, preferably Ala, Ser and Val
  misc_feature (390)..(390): Xaa can be any naturally occurring amino acid, preferably Ala, Ser and Val
  misc_feature (459)..(459): Xaa can be any naturally occurring amino acid, preferably Ala, Ser and Val
  misc_feature (586)..(586): Xaa can be any naturally occurring amino acid, preferably Ala, Ser and Val
  misc_feature (846)..(846): Xaa can be any naturally occurring amino acid, preferably Ala, Ser and Val
MENKLGEPLSAMLDELVDYFESAFRENRFDAARHNEVELILLNPPLSAVSVLHTIATVEESYVQYVLKAKDAKIRNRLSVKDVHGLDVKNYQLVERLDDANWERKAPVWEKSFPGATIKHSTEESHPFTDYRNYSGNIKLEFVNLVRARAKHLIVDAKFKYFIGNGSQNYNSLLYALNDPAAKPGVTLEFEIDVSREHLEREGFSFAELRASLYTVXQALFLAPADSVFLVQGGGPRPPVPTNMLKKYQLQTLETADLYVTEKTDGVLTYVLLRDKDIFXHFAHLGYFIRYRGRRKFAEPVSLMGEMTRAGSGEKVVHFIKLQTPALPDRLEERAFVEERLSDLGGGITIAVKRYHGPYATNGDLIAAXATLLREYREGVILFYRHAAPXDWKLKKVNTVDQAVNVVYRYMSNEPIILGDRDTFVEFKRYSNAHGTPKEFGFGKLVLSDGVNYLGNIYXLEFLQSEHDTGLERVLVPVKFVGEFSTAEGDDSLVRPRLEKTMLYLYSRNYYGNQEAVILEHLEDQRVRLGELLTGAPDVMAEAGKRVARDALRLNPDGSYFSQNRTRGPLGILSNFVKTQTISLYXSKTFMDNNAKRKVLAVDFGNGADLEKYFYAEAAVLIATDPDPAAIAEANSRYNKLNSGSKSKYYKFAYLQATIRSDAYLDEVRKTFYSGRFDVIDWQFAVHFSFHPLHYSTVMRNLAELAAPGAKVLITTMDGDYVASLAEERRFVIHRTQAEDNYLSIEKISDEKALVFSPTTMKRPMEEYIVRRADLNRVFEEYGFRAIDYVTFYDVIARNRKFLAGVSKLEARPSTSKFFALNRDAVNFEGTDLEELLRRYVVYVFXKA

SEQ ID NO: 190 - protein, 873 aa, Artificial sequence
  Catalytic polypeptide variant all cysteines substituted
  misc_feature (103)..(103): Xaa can be any naturally occurring amino acid, preferably Ala, Ser and Val
  misc_feature (170)..(170): Xaa can be any naturally occurring amino acid, preferably Ala, Ser and Val
  misc_feature (318)..(318): Xaa can be any naturally occurring amino acid, preferably Ala, Ser and Val
  misc_feature (339)..(339): Xaa can be any naturally occurring amino acid, preferably Ala, Ser and Val
  misc_feature (394)..(394): Xaa can be any naturally occurring amino acid, preferably Ala, Ser and Val
  misc_feature (465)..(465): Xaa can be any naturally occurring amino acid, preferably Ala, Ser and Val
  misc_feature (489)..(489): Xaa can be any naturally occurring amino acid, preferably Ala, Ser and Val
  misc_feature (621)..(621): Xaa can be any naturally occurring amino acid, preferably Ala, Ser and Val
  misc_feature (724)..(724): Xaa can be any naturally occurring amino acid, preferably Ala, Ser and Val
MNNTGSEIVAEYGKMYEKIRESNMDLEITELEFTQFDPSLLSLSKMFSNPNIKPLTDSYLEYILNKTSDEGNNIKIRIRIDFAVVGGLELNNKQLLDYVEHGXWESKETKDIWLSPDEFGRITSATEKQGTYINKVIQSGKINMIFVNRARVKFSDFVVDFKLKRKLGNXRQGNISNLYKSVNNAMYPPNPSLEIEHTGQFKKPWKDVKLEFTKVISWIIGHPIEEILTTTTPLFKIIPTSVITPAYLMNSIDPTQHKLTPKINGVGVMFKIDKKHVLVQQMLGPKVISIWRYKHLLTVTEDIYGSGEFIFDSDHSKXIYPYMILGHDVSTYKWEVQDXANLPYDHVLIKSKQWTGPFNDITDMLTAIYEMTVSKHSYETDGLILSSSYRHGKXDYKIKATSDIDIVGKVRFTYAGKSDPRQMATDGMILTVDYMSKNATNELVKINDNRIKLSPEFDYLNDIFXVKTTRVDPQLVKLSHAVVPIGFIXEYDVRTKEIMIRLTKSSTHLWTKYLGNNWTTIQTIQHSVPILADLKLLSKWIKSPEARDHTVLQDVKINGTKSMNEMDDGLDPDRLNPKTTYFKENRIRSPLGYISNFVKSLLISLYASKMFYSNSKKARVXSIDFGNGADLTKYFYAGIQELIATDPDSAAIDTAHDRYMKLNKNEKSNYYRFNYLKTSIRNENFVSVIRTVTDQLNFDVIDWQFAAHFSWNHKHIQNIMHSLXEITKPGGRVLITTMNGKGLESILDKDDSVTFKIHPIEPTGYTTITKTSPTTFSVLTPLTTTTAMTEYIIDPDQMIKTFYDYGFVLLDQGRFDEVFNINVPFFKAGSLLETRPSTASFFAQQRGVVHDIKNTQLDQLLKYYIYMVFQRGT

SEQ ID NO: 191 - protein, 891 aa, Artificial sequence
  Catalytic polypeptide variant all cysteines substituted
  misc_feature (52)..(52): Xaa can be any naturally occurring amino acid, preferably Ala, Ser and Val
  misc_feature (289)..(289): Xaa can be any naturally occurring amino acid, preferably Ala, Ser and Val
  misc_feature (303)..(303): Xaa can be any naturally occurring amino acid, preferably Ala, Ser and Val
  misc_feature (509)..(509): Xaa can be any naturally occurring amino acid, preferably Ala, Ser and Val
  misc_feature (625)..(625): Xaa can be any naturally occurring amino acid, preferably Ala, Ser and Val
  misc_feature (756)..(756): Xaa can be any naturally occurring amino acid, preferably Ala, Ser and Val
MEYEINVLIKEFIEFYNNVTYIDDDKLHNEVEITYLFPNLILLSNLYQYDEXKKTTYLEFSLSYTDNKKRIKFRQIVPYTTQDKFEIKNSYLANKLFNVNKLDIKSEISNKNILLNESNKEKIIFRHSTEKKIIDSDITLPSKQELLKNQVRLTFVNSIRIMIDNLIKIEFKYKANLGSASSNSLALSTYLNNIDTARILTTYYLEIELLSNTKIDNDILINVLNKSFGYIFSIRNLDNFSLSISNEYVPIKTFMITYDKLHIIDKSAYVMTPKINGESVSFYVENGIXNITIYNFIYKNINXNINKNVIMSGEGELIIIDNIKHIFPFYFNLIKDNKISYTDRYKQIEFYNTSIINFKSNMKIHFRNKNIFKFESNNTVNEVLKFYRSILINDMYKDINDGVILLDISNNNVKKDYKFKLDNTVDIIAKLETHKGIFRTQKDGLYLTLSLYNYDNKNFVKMLEINLKNEDLTTMIHDKKLISYDNVINMLLFKNVDFGPKILVSPIYXIVEYSFMSSTIIKLRIEKTNKFFRNNYNGNNLNVILSSKQFHEKYNMLSVIDNKLDYMIELNKSNNLLTEETHRSKLILNKDVQNYFLEQTTRTSLNILTNYIKTEAISITVSKLXSIIPNRHVLSIDIGRGGDLRKYYYVGISGMLGTEPDISALETARSRYKEFQISSRAKSSVYKFNSINISILDDNYINRVKEIYLIPQRIKFFGVIEWQLAIHYSYNEDTKNNILYKLKNLAGDGTKIIITXLNGDLLSEKLQNNPHLNYKISDTIYYKISKIDDNRISVLYNATMSTWLEEFLIKKTIINDFKNYNFVLDDIFTFDKIFNNDINKMLRVLAVFNRKSTKDFYSNIINDKNIYENKELQELLSFFIVYIFRYSSSLT

SEQ ID NO: 192 - protein, 860 aa, Artificial sequence
  Catalytic polypeptide variant all cysteines substituted
  misc_feature (276)..(276): Xaa can be any naturally occurring amino acid, preferably Ala, Ser and Val
  misc_feature (479)..(480): Xaa can be any naturally occurring amino acid, preferably Ala, Ser and Val
  misc_feature (596)..(596): Xaa can be any naturally occurring amino acid, preferably Ala, Ser and Val
  misc_feature (727)..(727): Xaa can be any naturally occurring amino acid, preferably Ala, Ser and Val
MEFNINSIIDKFWQFYSTHNPVDNVHNEIELTYLFDNLLLLSNIASYTETKKKLQLEYIIKYVDKSIKLRQRHEYDYPNFEITNTYMIQKLTNQWTIKKLINKIEENIGNEKFIIAHNTEEDNIKNNMIIPPKKLIMSNVTIHILSSIYFIINGNVRVEFKLKGTLGAADNNKMMLQTYLNNVLTYKQFTSYYIEIEILNKLSKDEFYRDITNAFRYIYSINNLNNFALSTKNISPSVKTFMLPFDSLYLMDKSKYFLTSKIDGEVVQFTVKNGIXDIVLYNFIFKNKQTNIPNHIVMKGFGEYKKIDNVKTIYPFVFTEIYSTDSKQKYNTRYEMIKFYNDNIKNKEFDITFKHKPIIPIEKDIVNEAIAYYKSLDEKITDGVILLDKESNIDYKLKIDNTVDVIASLNTHKSPNKIHKDGIYMTFNLYMNDEKNITELLKVEMKSNDLITYDNDINMLKFKNIHNRYGKNILYAPLXXIVEYSFLKSKIVNIRLDKTTKFFKSNYYGNSLKVILDSKTFHEKYVPLDTVGIDYLYTMFKINNEIYDKKNLILNQNVEKYFKEPIENNQQQRPPLNIFTNLIKTEAISIAASKLXAEIPNRHVLSIDIGRGGDINKYYYIGISGMLGTDPDISALSEAQERYNSLQTRKRVNSTVYKFSSLNISILDHDYLNKVKSTYMTQQKIKYFGLIEWQMAIHYSYNVDTKNKILNILKNLSTDGTKVIITXLNGNKIKNLLINNQNIKYKIQDNIYYNISKVNDDKIKVLYDATMTTWLEEYLIYDTIIEDFNKYNFILDDMFEFKDIYNNDAMLVLKTNSLFPRKATSVFYKNILNQNTKDNQVLELMNLFKVYIFKYKSYKK

SEQ ID NO: 193 - protein, 872 aa, Artificial sequence
  Catalytic polypeptide variant all cysteines substituted
  misc_feature (12)..(12): Xaa can be any naturally occurring amino acid, preferably Ala, Ser and Val
  misc_feature (280)..(280): Xaa can be any naturally occurring amino acid, preferably Ala, Ser and Val
  misc_feature (294)..(294): Xaa can be any naturally occurring amino acid, preferably Ala, Ser and Val
  misc_feature (352)..(352): Xaa can be any naturally occurring amino acid, preferably Ala, Ser and Val
  misc_feature (423)..(423): Xaa can be any naturally occurring amino acid, preferably Ala, Ser and Val
  misc_feature (495)..(495): Xaa can be any naturally occurring amino acid, preferably Ala, Ser and Val
  misc_feature (738)..(738): Xaa can be any naturally occurring amino acid, preferably Ala, Ser and Val
  misc_feature (810)..(810): Xaa can be any naturally occurring amino acid, preferably Ala, Ser and Val
  misc_feature (871)..(871): Xaa can be any naturally occurring amino acid, preferably Ala, Ser and Val
MSIDVSDIINDXIKFYSNINFDSNPNVNNEIEFTYINPDLRILSNIYTDNNESKKKTYLEYVLKFANKKSKLRQKYKYDYPTFEIANSYFLDKLTNNWERKTIISEDKININKNEYILLRHNTEYQDNDIELPLLNDILDKINVLFVSQLYIIINDLIKVEFKIKSNIGPLSSNKLLLSTHFNDIETYRKNITYYLEIEVLSKTKLDNNVLYDNLVKSFEYIYKSKNISNISLVTIKNKPKIKTHMIQYNKLNTIDKESYIMAIKIDGDVVEFNVMNGIXNIIIYDMVYKNFSXNIDKNIQMIGMGEYIKVDNVKKIYPFYFSKLSYNNKKIINNILDRYKQIQYYNDNLLXHKPNMQIKFENKLTLKFDENNVTTNVLKFYKSIENSSFKNIYDGIVLLDITDNDSKKDYKFKIDNTVDVIXKLDTYRGTYILHNDNKLYITFTLYQYDNKNFTEILKYEEKNEIIEYNNYVNLLIFNNNNKFGPKKMLSPIWXIVEYSFLESKIIGLRIDKTNNFYRQNYNGNNLDVILTSKHIHEEFPSNYNIDYLMSLNETINVIDNNPHRSKLLLNKEVNKYFMNNTIRTSINILTNYLKTNGISMAISKLVTTLPNRYVLSIDIGRGGDLTKYYYVGITGMLGTDPDIFAIKEARDRYKKLQTISNAQASIYKFDSLNMSILNDNYENEIKNKFMTHHKIQYFGVIEWQLAIHYSYNNNTKDMILLKLKNLSNDGTKVIITXLDGDEITNRLNENPNLIYNIQPGITYKISKISDDKISVLYNATMTEWLEEYIITDKIIDDFAMYNFILSDVXKFDDIFKYNSDKSVEVLSNFLRKSTKKFYNDIKNDKNIYNNDDIKKIMSLFKVYTFVYSSXK

SEQ ID NO: 194 - protein, 872 aa, Artificial sequence
  Catalytic polypeptide variant all cysteines substituted
  misc_feature (280)..(280): Xaa can be any naturally occurring amino acid, preferably Ala, Ser and Val
  misc_feature (294)..(294): Xaa can be any naturally occurring amino acid, preferably Ala, Ser and Val
  misc_feature (423)..(423): Xaa can be any naturally occurring amino acid, preferably Ala, Ser and Val
  misc_feature (495)..(495): Xaa can be any naturally occurring amino acid, preferably Ala, Ser and Val
  misc_feature (738)..(738): Xaa can be any naturally occurring amino acid, preferably Ala, Ser and Val
MSIEINEIINKFVKFYDNIKLDTNENIKNEVELTLINPDLMLLSNIYTENNESKKKTYLEYNLKFSKKKSKLRQRHEYDYSTYEIPNSHLTDRLTNNWETKTVIDEEKIDINKHEHVLMRHNIEYIDNNIELPLINDIFDRISVIFVSQVYIIIDSVLKIEFKIKSYIGPLSSNKLSLSTHFNDIDTSRKNISYYLEIEILPNIKLENNILQEKLEKAFSYIYKSTNISNLSLVTIKEPSRIKTFTIQYNKLNTIDKDSYVMAIKIDGNVVNFTVKNSIXSVIIYNVIYKNYKXNIDKNIEIKGMGEYIKVNNVKKIYPFYFTEIKYVNRKATNIIENRYDQIQFYNSIITSFKEPMQIKFENKLTLKFNENNVSTNVVNFYKSIDNSNMKDIYDGIILIDISNNKDKKDYKFKIDNTVDIVXRLDTYRGVYILHSGGKLHISFSLFAYDDKNFAELTKYTVKSDIIKYISDANLLVFNNNDKFGPSKLLSPIYXIVEYSFLHSKIIGLRIDKTNNFYRQNYNGNSLDVIILSKQIHEQFPSNYNIDYLLSLNESSNIIDNNPHRSKLLLNKKVDKYFLDNTVRTSINILTNYMKTNAISMSISRLVTVLPNRYVLSIDIGRGGDLTKYYYVGISGILGTDPDTIAIQESRERYKNLQLKSNAQSSVYKFHTLNISILNDNYENDVKQSFMNQQKINFFGVIEWQLAIHYSYNNNTKDSILLKLKNLSSNGTKVIITXLDGNELINRLNINEHIIYNIQPGITYKITKISEDRISVLYNATMTNWLEEYIITDGIIYDFAKYNFILHDMFTFEDIFNKNTYKTIDILSNFGRKSTNMFYKTIKNDSNIYNNEDINKLMSLFKVYIFIYSSYN

SEQ ID NO: 195 - protein, 872 aa, Artificial sequence
  Catalytic polypeptide variant all cysteines substituted
  misc_feature (280)..(280): Xaa can be any naturally occurring amino acid, preferably Ala, Ser and Val
  misc_feature (294)..(294): Xaa can be any naturally occurring amino acid, preferably Ala, Ser and Val
  misc_feature (423)..(423): Xaa can be any naturally occurring amino acid, preferably Ala, Ser and Val
  misc_feature (495)..(495): Xaa can be any naturally occurring amino acid, preferably Ala, Ser and Val
  misc_feature (738)..(738): Xaa can be any naturally occurring amino acid, preferably Ala, Ser and Val
MSIDITDIINKYVQFYDKVNLDNNPNINNEVELTYINPDLMLLSNIFTDNNESKKRTYLEYNLRFTNKKSKLRQRHKYDYPTFEIANSYFLDNLTNNWEKKTIIYEEKIDINKNEHILLRHNTEYQDNDIELPLLKDILDKINVIFVSQVYIIINNIIRVEFKIKSNIGPLASNKLLLSTHFNDMETYRKNISYYMEIEILSNIKLDNTTLRDNLIKAFEYIYKSKNILNLSLVTIKNSPKLKTHMVQYNKLNSIDKDAYIMTIKIDGDVVEFNVKNGIXNIIIYNIIYKNFTXNIDKNIQMRGLGEYIKINNIRKIYPFYFFELSYTNKKIITNISDRYQQIQYYNNNLMTFKSSLQIKFENKLTLKFDENNVSTNVINFYKSIDNSNLKDIYDGVILLDISDNNLKKDYKFKIDNTVDVIXKLDTYRGTFILHKDNMLYITFTLYQYDNKNFTEILKYEVKNDIIEYNNYVNLLLFTNNNKFGPIKLVSPIYXIVEYSFLQSKIIGLRIDKTNNFYRQNYNGNNLDVIITSKQIHEQFPLNYNIDYLISLNNTTNIIDNNPHRSKLLLNKEVNKYFIDNTIRTSINILTNYIKTNAISMSISKLVTTIPNRYVLSIDIGRGGDLTKYYYVGITGMLGTDPDVFAIEEARDRYKKLQLKSNAQSSVYKFHTLNMSILNDKYEQEIKNNFMNQHKISFFGVIEWQLAIHYSYNDNTKDSILLKLKNLSRNGTKIIITXLDGNELINRLNINPNLIYNIQSGITYKISKVSDNKISILYNATMTEWLDEYIITNDIIDDFAKYNFILDDVFTFNDIFNDNTHKSIEVLSTFSRKSTNLFYATIKNDNNIYNNEDIKKLMSLFKVYVFIYSSHN

SEQ ID NO: 196 - protein, 872 aa, Artificial sequence
  Catalytic polypeptide variant all cysteines substituted
  misc_feature (280)..(280): Xaa can be any naturally occurring amino acid, preferably Ala, Ser and Val
  misc_feature (294)..(294): Xaa can be any naturally occurring amino acid, preferably Ala, Ser and Val
  misc_feature (423)..(423): Xaa can be any naturally occurring amino acid, preferably Ala, Ser and Val
  misc_feature (495)..(495): Xaa can be any naturally occurring amino acid, preferably Ala, Ser and Val
  misc_feature (738)..(738): Xaa can be any naturally occurring amino acid, preferably Ala, Ser and Val
MSIDITDIINKYLQFYDKVNLDNNPNINNEVELTYINPDLMLLSNIFTDNNESKKRTYLEYNLRFTNKKSKLRQRHKYDYPTFEIANSYFLDNLTNNWEKKTIIYEEKIDINKNEHILLRHNTEYQDNDIELPLLKDILDKINVIFVSQVYIIINNIIRVEFKIKSNIGPLASNKLLLSTHFNDMETYRKNISYYMEIEILSNIKLDNTTLRDNLIKAFEYIYKSKNISNLSLVTIKNSPKLKTHMIQYNKLNIIDKDAYIMTVKIDGDVVEFNVKNGIXNIIIYNIIYKNFTXNIDKNIQMRGLGEYIKVNNIRKIYPFYFFELSYTNKKIITNISDRYQQIQYYNNNLMPFKTSLQIKFENKLTLKFDENNVSTNVINFYKSIDNSNLKDIYDGVILLDISDNNLKKDYKFKIDNTVDVIXKLDTYRGTYILHKDNMLYITFTLYQYDNKNFTEILKYEVKNDIIEYNNYVNLLLFTNNNKFGPIKLVSPIYXIVEYSFLQSKIIGLRIDKTNNFYRQNYNGNNLDVIITSKQIHEQFPLNYNIDYLISLNDTKNIIDNNPHRSKLLLNKDVNKYFIDNTIRTSINILTNYIKTNAISMSISKLVTTIPNRYVLSIDIGRGGDLTKYYYVGITGMLGTDPDVFAIEEARDRYKKLQLKSNAQSSVYKFHTLNMSILNDKYEQEIKNNFMNQHKISFFGVIEWQLAIHYSYNDNTKDSILLKLKNLSRNGTKIIITXLDGNELINRLNVNPNLIYNIQSGITYKISKVSDNKISILYNATMTEWLDEYIITNDIIDDFAKYNFILDDVFAFNDIFNDNTQKSIEVLSTFSRKSTNLFYTTIKNDNNIYNNEDIKKLMSLFKVYVFIYSSHN

SEQ ID NO: 197 - protein, 869 aa, Artificial sequence
  Catalytic polypeptide variant all cysteines substituted
  misc_feature (280)..(280): Xaa can be any naturally occurring amino acid, preferably Ala, Ser and Val
  misc_feature (294)..(294): Xaa can be any naturally occurring amino acid, preferably Ala, Ser and Val
  misc_feature (420)..(420): Xaa can be any naturally occurring amino acid, preferably Ala, Ser and Val
  misc_feature (492)..(492): Xaa can be any naturally occurring amino acid, preferably Ala, Ser and Val
  misc_feature (735)..(735): Xaa can be any naturally occurring amino acid, preferably Ala, Ser and Val
MSIDINDIISKYIKFYENVKFDTSKNVNNEVELTYINPDLMLLSNIFTDNNESKKKTYLEYNLKFINKNSKLRQIHKYNYSTFEIANSYFLDKLTNNWENKTVLSEEKIDINKQEHILLRHNIEYQDDEVKLPLLNDLLDKINVIFVSHVYIIINSIIRVEFKIKSNIGPLSSNKLLLSTHFNDIDTYRKNISYYLEIEVLPQAKVDSKILYENLIKAFEYVYKSKNISNISILKTKEIPKIKTHMIQYNKLNTIDKDSYILAVKIDGDVVEFNVKNGIXNITIYNNIYKNFTXNIDKNIQMRGLGEYIKVNNIKKIYPFYFYEISYVDKNNIIDRYEQIQFYNNNLLNYKNAMQIKFEIKLVLKFDENNVSTNVLNFYKSIDKSNLKDIYDGVILLDTSNNNLKKDYKFKIDNTIDIVXKIDTYRGIFVLHNDNNLYITFTLYQYDNKNFVEISKYEVKNDIIKYNNYANLLIFNNINKFGPNKLLAPVYXIVEYSFLQSKIIGLRIDKTNNFYRQHYNGNNLEVILMSKQIHEQYPKNYNIDYLMSLNESINIIDNNPHRSKLLLNKNINKYFMDNTVRTSINILTNFIKTNAISISISKLVAVLPNRYVLSIDIGRGGDLTKYYYVGITGILGTDPDPFAIQEARDRYKKLQLKSNAQSSVYKFHTLNISILDDKYIQEIHRNFMSQQKIKYFGIIEWQLALHYSYNNNTKNTILRNIKTISGDGTKLIITXLDGNELLNRLSVNPNLIYNIQPGITYKISKISDEKISVIYNATMSDWLEEYIITDSIISDFEKYNFIIHDMFSFNDIFNDDTQKLIDVLSTFSRKSTNIFYNNIKNDSNIYNNDDIKKLMALFKVYVFIYSSSN

SEQ ID NO: 198 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDSAIMVASDVXKKNLDLFMSHVKSVTKSSSWKDVNSVQFSILNDPVDTEFINKFLEFSNRVYEALYYVHSLLYSSMTSDSKSIENKHQRRLVKLLL

SEQ ID NO: 199 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDTAIMVASDVXKKNLDLFMSHVKSVTKSSSWKDVNSVQFSILNDPVDTEFINKFLEFSNRVYEALYYVHSLLYSSMTSDSKSIENKHQRRLVKLLL

SEQ ID NO: 200 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDSAIMVASNVXKKNLDLFMSHVKSVTKSSSWKDVNSVQFSILNDPVDTEFINKFLEFSNRVYEALYYVHSLLYSSMTSDSKSIENKHQRRLVKLLL

SEQ ID NO: 201 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIVKNIREGTHVLLPFYETLPELNLSLGKSPLPSLEYGANYFLQISRVNDLNRIPTDMLKLFTHDIMLPESDLDKVYEILKINSVKYYGRSTKADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDSAIMVASDVXKKNLDLFMSHVKSVTKSSSWKDVNSVQFSILNDPVDTEFINKFLEFSNRVYEALYYVHSLLYSSMTSDSKSIENKHQRRLVKLLL

SEQ ID NO: 202 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDSAIIVASDVXKKNLDLFMSHVKSVTKSSSWKDVNSVQFSILNDPVDTEFINKFLEFSNRVYEALYYVHSLLYSSMTSDSKSIENKHQRRLVKLLL

SEQ ID NO: 203 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDEIVKNIREGTHVLLPFYETLPELNLSLGKSPLPSLEYGANYFLQISRVNDLNRMPTDMLKLFTHDIMLPESDLDKVYEILKINSVKYYGRSTRADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDSAIMVASDVYKKNLDLFMSHVKSVTKSSSWKDVNTVQFSILNDPVDTEFINKFLEFSNRVYEALYYVHSLLYSSMTSDSKSIENKHQRRLVKLLL

SEQ ID NO: 204 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIIKNIREGTHILLPFYETLPELNLTLGKSPLPSLEYGTNYFLQISRVNDLNRMPTDMLKLFTHDIMLPESDLDKVYKILNINSVKYYGRSTKADAVVADLSARNKLFKRERDAIKSNNHLTENNLYISDYKMLTFDVFRPLFDFVNEKYXIVKLPTLFGRXVVDTMRIYXSLFKNVRLLKXVSDSWLKDSAIMVASDVXKKNMDLFMSHVKSVTKSSSWKDANSVQFSILNDPVDTEFINKFLEFSNRVYEALYYVHSLLYSSMTSDSKSLENEYQRRLVKLLL

SEQ ID NO: 205 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MESIIKNIKDGIYILLPYYENLPDLDLVLGKTPLPSLEYGTNYFLHISRVNDLNRMPTDMLKLFTHNIMLPENDLEKVYDILNIKSVKSYGRTIKADAIVADLSARNKLFKKEREGIKSNNYLTENNLYVSDYTMLTLDIFRPLFDIVSEKYXIVKLPTLFGRXVIDSMRIYXSIFKNVRLFKXVSDSWLKDSSIMVASDINKKNLDIFMLHIRSVTKSNIWKDSNSVQFSILKEPVDKEFINKFLEFSNKVYESLYYIHSLLYLSMTSDSKSIENEYQRRLAKALL

SEQ ID NO: 206 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
METIIKNIKDGVYTLLPFYESLPELNLSLGKSPLPSLEYGANYFLQLSRVNDLNRFPTDLLSLFTHDLMLPENDLESVYDILKIQSVKSYGKSIKADAVVADLSAKNKLFKKDRELIKSNNYLTENNLYISDYKMLTFEVFRPLFDFVSEKYXIVKMPTLFGRGIIDTMRVYXSLFKSVKMFKXTNDSWLKDSAIMVATDVYKKNMDEFMSHVRSVTKSSNWKDSNNVQFTILQESVDREFIDKFLDFSTSVYESLYYVHSLLYSSMISPNKSIENEFQKKLTKLLL

SEQ ID NO: 207 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDKITRNIREGIHILLPFYENLPDISLSLGKSPLPSLEYGTNYFLQLSRVNDLNRLPTDMLSLFTHDIMLPETDMEKVYDILNIKSVKSYGKSIKADAVVADLSARNRLFKKDRELIKSNNYLTDNNLYISDYKMLTFEVFRPLFDLSSEKYXIVKLPTLFGKXVIDTIRVYXSLFKSVRLFKXASDSWLKDSAIMVASDIYKKNIDIFMSHIRSVLKSQYWKDSNNVQFSILKESVDKEFINKFLEFSTSVYESLYYVHSLLYSSMISDNKSIENEYQKKLTKLLL

SEQ ID NO: 208 - protein, 287 aa, Artificial sequence
  Regulatory polypeptide variant all cysteines substituted
  misc_feature (7)..(7): Xaa can be any naturally occurring amino acid, preferably Ala, Ser and Val
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
  misc_feature (208)..(208): Xaa can be any naturally occurring amino acid, preferably Ala, Ser and Val
MEQITKXIKEGTHTLFPFYDDLPDINLFLGKSPLPSLEYGANYFLQLSRVNDLNRLPTDLLSLFTHEIMIQENDLEKVYDILNIHSVKSYGKTIKADAVVIDLSAKNKLFKRDRELIKSNNYLTENNLYISDYKMLTFEVFRPLFEMSSEKYXIIKLPTLFGKXVIDTTRIYXSLFKSVRLFKXANDSWLKDSAIIVASNAXKKNIDXFMSHVRSVTKSLNWKESNNVQFSILKDSVDKEFIDKFLNFSTKVYESLYYVHSLLYASMTSESKSIENEYQKKLTKLLL

SEQ ID NO: 209 - protein, 287 aa, Artificial sequence
  Regulatory polypeptide variant all cysteines substituted
  misc_feature (7)..(7): Xaa can be any naturally occurring amino acid, preferably Ala, Ser and Val
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDQIAKXIKEGTHTLFPFYDNLPDVNLFLGNSPLPSLEYGANYFLQLSRVNDLNRLPTDLLSLFTHEIMVQENDLEKVYDILNIHSVKSYGKTIKADAVVIDLSAKNKLFKKDRELIKSNNYLTENNLYISDYKMLTFEVFRPLFEMSSEKYXIIKLPTLFGRXVIDTTRVYXSLFKSVRLFKXANDSWLKDSAIIVASNAXKKNIDYFMSHIRSVTKSLNWKESNNVQFSILKDSVDKEFIDKFLNFSTKVYESLYYVHSLLYSSMTSESKSIENEYQKKLTKLLL

SEQ ID NO: 210 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDQVTKNIKEGVHTLLPFYESLPELHLVFGKSPLPGLEYGANYFLQLSKLNDLNRLPTDLLSLFTHDLITPETDLEKVYKTLNIKSVKSYGKSTKADAIVADLSAKNRLFKKDRDLVKSNNYLTENNLYIGDYKMLTFEVFRPLFDIVSERFXIIKLPTLFGKGVIDVTRVYXSLFKSVRLIKXASDSWLKDSAIIVAEQVYKKNMDEFMTYVRHVTKSPTWKDSNNVQFSILKTSVDKEFIDKFLNFSNSVYESLYYVHSLLYASMTSERKSIENEYQKKLMKILL

SEQ ID NO: 211 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDQVTKHIKEGVHTLLPFYDSLPELHLVFGKSPLPGLEYGANYFLQLSKLNDLNRLPTDLLSLFTHDLITPETDLEKVYKTLHIKSVKSYGKSTKADAIVADLSAKNRLFKKDRDLVKSNNYLTENNLYIGDYKMLTFEVFRPLFDIASERFXIIKLPTLFGRGVVDVLRVYXSLFKSVRLFKXASDSWLKDSAIMVAEHVHKKNMDEFMTYIRHVTKSPTWKDSNNVQFSILKTSADKEFIDKFLNFSNAVYESLYYVHSLLYASMTSERKSIENEYQKKLMKILL

SEQ ID NO: 212 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDEVIKNIKEGIYILLPFYEHLPDLNLTLGKSPLPSLEYGTNYFLQLSRVNDLNRLPTDLLSLFTHDLMIPETDLEKVYEILNIKSIKSYGKNIKADAVVADLSAKNKFFKKERDLIKSNNYLNENNLYVSDYKMLTFEVFRPLFEISVEKFXIIKLPTLFGRXIVDTLRVYXSLFKSVRLFKXASDSWLKDSAIMVASEPYKKNFDSFMTEIKKTTKSSIWKDDNNVQFNILEYPVDKEFINKFLEFSTSVYESLYYVHSLLYSSMTSENKSIENEYQKKLVKILL

SEQ ID NO: 213 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDDVIKNIKEGIYILLPFYEHLPDLNLTLGKSPLPSLEYGTNYFLQLSRVNDLNRLPTDLLSLFTHDLMIPETDLEKVYEILNIKSIKSYGKNIKADAVVADLSAKNKFFKKERDLIKSNNYLNENNLYVSDYKMLTFEVFRPLFEMSVEKFXIIKLPTLFGRXIVDTLRVYXSLFKSVRLFKXASDSWLKDSAIMVASEPYKKNFDSFMAEIKKTTKSSIWKDANNVQFNILEYPVDKEFINKFLEFSTSVYESLYYVHSLLYSSMTSENKSIENEYQKKLVKILL

SEQ ID NO: 214 - protein, 287 aa, Artificial sequence
  Regulatory polypeptide variant all cysteines substituted
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDDVIKNIKEGIYILLPFYKHLPDLNLTLGKSPLPSLEYGTNYFLQLSRVNDLNRLPTDLLSLFTHDLMIPETDLEKVYEILNIKSIKSYGKNIKADAVVADLSAKNKFFKKERDLIKSNNYLNENNLYVSDYKMLTFEVFRPLFEMSVEKFXIIKLPTLFGRXIVDTLRVYXSLFKSVRLFKXASDSWLKDSAIMVASEPYKKNFDSFMAEIKKTTKSSIWKDTNNVQFNILEYPVDKEFINKFLEFSTSVYESLYYVHSLLYSSMTSENKSIENEYQKKLVKILL

SEQ ID NO: 215 - protein, 284 aa, Artificial sequence
  Regulatory polypeptide variant all cysteines substituted
  misc_feature (150)..(150): Xaa can be any naturally occurring amino acid, preferably Ala, Ser and Val
  misc_feature (170)..(170): Xaa can be any naturally occurring amino acid, preferably Ala, Ser and Val
  misc_feature (181)..(181): Xaa can be any naturally occurring amino acid, preferably Ala, Ser and Val
MDSIIKDGIHVLMPFYENLPELNLTFGKSPLPSLEYGANYFLQLSKVNDLNRLPTDLFSLYTHDLIQPETDLEKIYDILDIKSVKSYGKTIKSDAIVADLSAKNRLFKKDRDLIKSNNYLTENNLFISDYKMITFEIFRPLFDISNEKYXIIKIPTLFGRTIVDTIRIYXSIFKTVRMFKXVSDSWFKDSAVMVASGLYKKNLDIFLTYIRSVIKTNNIKNYNNQQFNIVKSPTDKEFIDKFLEFSIPIYEALYYIHSLLLSSMTSKNKSIENEFQKKLTRLLL

SEQ ID NO: 216 - protein, 292 aa, Artificial sequence
  Regulatory polypeptide variant all cysteines substituted
  misc_feature (32)..(32): Xaa can be any naturally occurring amino acid, preferably Ala, Ser and Val
  misc_feature (157)..(157): Xaa can be any naturally occurring amino acid, preferably Ala, Ser and Val
  misc_feature (177)..(177): Xaa can be any naturally occurring amino acid, preferably Ala, Ser and Val
  misc_feature (188)..(188): Xaa can be any naturally occurring amino acid, preferably Ala, Ser and Val
MESAVAAVREVVRDGISMLLPFYETLPELHLXLGKNHLPSLEYGTNYFLQLSKVNDLNRMSTDMLRLFTHDIAIPETDLEKIYGVLGVKNVKSYGRGIKADAVVVDLGARNKIYKKDRDFVRSNNYLTENNLYMSDYKLLTFEVFRPVFEFSSEKYXIVKLPTAFGRGVVNVARVYXSLFRTVRLIKXASDSWLKDSFVIVASEPHAANMARFASYVASVTRSSTWKESNNVQFTILDEPVEREFIDKFLAFSARVYQALYYIHSLLYASMTSESKSIENEHQKRIMKLLAG

SEQ ID NO: 217 - protein, 295 aa, Artificial sequence
  Regulatory polypeptide variant all cysteines substituted
  misc_feature (20)..(20): Xaa can be any naturally occurring amino acid, preferably Ala, Ser and Val
  misc_feature (160)..(160): Xaa can be any naturally occurring amino acid, preferably Ala, Ser and Val
  misc_feature (180)..(180): Xaa can be any naturally occurring amino acid, preferably Ala, Ser and Val
  misc_feature (189)..(189): Xaa can be any naturally occurring amino acid, preferably Ala, Ser and Val
  misc_feature (205)..(205): Xaa can be any naturally occurring amino acid, preferably Ala, Ser and Val
MAAPTGFAAQVHALVRDGLXADMPFYETLPELNLVFGKNHTPSLQYGANYFLQLSKVNDLNRMSTDMVNLYTHDLTAPETDLEKVYEEHGIESIKAYGKSIRADAIVADLSARNKLFKKERTFVKSNNYLKENNFYVSDYSMMTFEVFRPLFDLGSERFXIVKLPTLFGRTVANAVRVYXSLFRRVQLXKGASDSWLKDSALLVXRDAYTPNLERFLAYVRASTRSPAWREANNAPFTLLDAPVEREFLEQFLGFSNQVYMAIYYVHTLLYNSMTSESKSIENDFQRRLVRLLRS

SEQ ID NO: 218 - protein, 290 aa, Artificial sequence
  Regulatory polypeptide variant all cysteines substituted
  misc_feature (176)..(176): Xaa can be any naturally occurring amino acid, preferably Ala, Ser and Val
  misc_feature (187)..(187): Xaa can be any naturally occurring amino acid, preferably Ala, Ser and Val
MEATDAVRRSIREGLSVTLPTFETAPRLDLQLGAGHLPSLEYGANYFLQLSRVNDLNRMPTDMLRLYTHDLMTEERDVEKVLEAHGIASVRGVQRGGKADAVVLDLSARNKLYRKERGMIRSNNHLTENNLYVADYHAITFAVMRPLLEISQERFVVLKLPTLFGTDVVHALRVYXSLFGTVRLFKXVSDSWLKDSAVMVASDPRRQDIAKFVAHVRDRAKTASWRESLAVPFRILRDPVESEFVDRFLAFAGRVYDALYVTHSLLYESMTSESKSIENESQRKLKLLLQ

SEQ ID NO: 219 - protein, 289 aa, Artificial sequence
  Regulatory polypeptide variant all cysteines substituted
  misc_feature (50)..(50): Xaa can be any naturally occurring amino acid, preferably Ala, Ser and Val
  misc_feature (175)..(175): Xaa can be any naturally occurring amino acid, preferably Ala, Ser and Val
  misc_feature (186)..(186): Xaa can be any naturally occurring amino acid, preferably Ala, Ser and Val
MDAIETVRRSIREGLSVTLPTFDSTPALDLQLGAGHLPSLAYGTNYFLQXSRVNDLNRMPTEMLSLYTHDLMIDERDVEKVLEAHGITSVRSGARGKADAVVLDLSARNRLYRKERGAIRSNNHLTENNLYVADYHAITFAVMRPLLEISQERFVVLKLPTLFGTDVVHALRVYXSLFGTVRLFKXVSDSWLKDSAVMVASEPRRAAIAAFATHVRERTKAAAWRDALAVPFRILRDPVESEFVDRFVAFATRVYEALYVTHSLLYESMTSESKSIENESQRKLKLLLQ

SEQ ID NO: 220 - protein, 300 aa, Artificial sequence
  Regulatory polypeptide variant all cysteines substituted
  misc_feature (5)..(5): Xaa can be any naturally occurring amino acid, preferably Ala, Ser and Val
  misc_feature (61)..(61): Xaa can be any naturally occurring amino acid, preferably Ala, Ser and Val
  misc_feature (186)..(186): Xaa can be any naturally occurring amino acid, preferably Ala, Ser and Val
  misc_feature (197)..(197): Xaa can be any naturally occurring amino acid, preferably Ala, Ser and Val
MKTDXASNKSAMDAVEAVRRSIREGLSVTLPTFDSTPALDLQLGVGHLPSLAYGTNYFLQXSRVNDINRMPTEMLSLYTHDLMIDERDVEKVLEAHGITSVRSRARGRADAVVLDLSARNRLYRKERGAIRSNNHLTENNLYVADYHAITFAVMRPLLEITQERFVVLKLPTLFGTDVVHALRVYXSLFGTVRLFKXVSDSWLKDSAVMVASEPRRAAIAAFVTHVRERTKAAAWRDSLAVPFRVLKDPVESEFVDRFVAFASRVYEALYVTHSLLYESMTSESKSIENESQRKLKLLLQ

SEQ ID NO: 221 - protein, 289 aa, Artificial sequence
  Regulatory polypeptide variant all cysteines substituted
  misc_feature (132)..(132): Xaa can be any naturally occurring amino acid, preferably Ala, Ser and Val
  misc_feature (154)..(154): Xaa can be any naturally occurring amino acid, preferably Ala, Ser and Val
  misc_feature (174)..(174): Xaa can be any naturally occurring amino acid, preferably Ala, Ser and Val
  misc_feature (199)..(199): Xaa can be any naturally occurring amino acid, preferably Ala, Ser and Val
MNTDKIAEIIKNGLYITMPFYETLPEMNLVFGKNHLPTLEYGTNYFLQLSKINDINRFSTDTLALFTHDLNKESDINKLYEPYNIETVKLYGKYIQADAVVVDLSAPNKLFKKEHPYYKSNNELKENNLYIXDYNMITFEVFRAIFEMSSEKIXIVKVPTLFGNTIINVIRIYXSLFKNVRLYKLSADSWLKDSAIIVXQSPHTSNINKFISHVRKVTKSHTWLDSNNKNFIILHNSVEKEFIEKFLSFSYKIYEVLFYVHSLLIDSMKSEQQSLDNEHQKKLIKLLRN

SEQ ID NO: 222 - protein, 289 aa, Artificial sequence
  Regulatory polypeptide variant all cysteines substituted
  misc_feature (132)..(132): Xaa can be any naturally occurring amino acid, preferably Ala, Ser and Val
  misc_feature (154)..(154): Xaa can be any naturally occurring amino acid, preferably Ala, Ser and Val
  misc_feature (174)..(174): Xaa can be any naturally occurring amino acid, preferably Ala, Ser and Val
  misc_feature (199)..(199): Xaa can be any naturally occurring amino acid, preferably Ala, Ser and Val
MNIDRITAFIKNGISVRMPFYDTLPEMDLVFGKNHLPSLEYGANYFLQLSKINDINRLSTEMLALYTHDLNKESDISKLFDSYNIKTIKSYGRSIQADAVFVDLRPSNSLYKNEHPYYKSNNYLKENNLYIXDYTMITFEIYRPIFELSTEKTXIIKVPTLFGKNIINAVRVYXSLFKYVKLYKLSADSWLKDSAIIVXQQPHTTNINKFITYIRKVTKSQTWVDSNNINFILIHDSVEKEFIEKFLSFSYKIYESLYYVHSLLYSSMTSDLQSLDNEYQKKLIKLLRG

SEQ ID NO: 223 - protein, 289 aa, Artificial sequence; identical to SEQ ID NO: 222
  Regulatory polypeptide variant all cysteines substituted
  misc_feature (132)..(132): Xaa can be any naturally occurring amino acid, preferably Ala, Ser and Val
  misc_feature (154)..(154): Xaa can be any naturally occurring amino acid, preferably Ala, Ser and Val
  misc_feature (174)..(174): Xaa can be any naturally occurring amino acid, preferably Ala, Ser and Val
  misc_feature (199)..(199): Xaa can be any naturally occurring amino acid, preferably Ala, Ser and Val

SEQ ID NO: 224 - protein, 289 aa, Artificial sequence
  Regulatory polypeptide variant all cysteines substituted
  misc_feature (132)..(132): Xaa can be any naturally occurring amino acid, preferably Ala, Ser and Val
  misc_feature (154)..(154): Xaa can be any naturally occurring amino acid, preferably Ala, Ser and Val
  misc_feature (174)..(174): Xaa can be any naturally occurring amino acid, preferably Ala, Ser and Val
  misc_feature (199)..(199): Xaa can be any naturally occurring amino acid, preferably Ala, Ser and Val
MNIDRITSFIKNGISVRMPFYDTLPEMDLVFGKNHLPSLEYGANYFLQLSKINDINRLSTEMLALYTHDLNKESDISKLFDSYNIKTIKSYGRSIQADAVFVDLRPSNSLYKNEHPYYKSNNYLKENNLYIXDYTMITFEIYRPIFELSTEKTXIIKVPTLFGKTIINAVRVYXSLFKYVKLYKLSADSWLKDSAIIVXQQPHTANINKFITYIRKVTKSQTWVDSNNINFILIHDSVEREFIEKFLSFSYKIYESLYYVHSLLYSSMTSDLQSLDNEYQKKLIKLLRG

SEQ ID NO: 225 - protein, 296 aa, Artificial sequence
  Regulatory polypeptide variant all cysteines substituted
  misc_feature (11)..(11): Xaa can be any naturally occurring amino acid, preferably Ala, Ser and Val
  misc_feature (139)..(139): Xaa can be any naturally occurring amino acid, preferably Ala, Ser and Val
  misc_feature (161)..(161): Xaa can be any naturally occurring amino acid, preferably Ala, Ser and Val
  misc_feature (181)..(181): Xaa can be any naturally occurring amino acid, preferably Ala, Ser and Val
  misc_feature (190)..(190): Xaa can be any naturally occurring amino acid, preferably Ala, Ser and Val
  misc_feature (206)..(206): Xaa can be any naturally occurring amino acid, preferably Ala, Ser and Val
MEDNIKQQKNXDVTHIIRNGISKKLAFYESLPPMNLVFGKNHLPSLEYGANYFLQLSKINDINRLSTDMLALYTHDLNKESDIPKLYEPYNIKTIKSYGKYIQADAVVVDFSAQNMLFKKDHPFYKSNNYLKENNLYIXDYKMITFEIYRPVFELLSEKIXIIKVPTLFGRTIVNVLRVYXSLFKQVTIXKLPSDSWLKDSAIIIXQQPYSPNINKFTSYVKKVTGSQSWTDTNNRHFILIHDSIEPEFIELFLSFSYKIYEALYYVHSLLYNSMTSDAQSLDNDYQKKLIKLLRN

SEQ ID NO: 226 - protein, 289 aa, Artificial sequence
  Regulatory polypeptide variant all cysteines substituted
  misc_feature (132)..(132): Xaa can be any naturally occurring amino acid, preferably Ala, Ser and Val
  misc_feature (154)..(154): Xaa can be any naturally occurring amino acid, preferably Ala, Ser and Val
  misc_feature (174)..(174): Xaa can be any naturally occurring amino acid, preferably Ala, Ser and Val
  misc_feature (199)..(199): Xaa can be any naturally occurring amino acid, preferably Ala, Ser and Val
MNTDRITAFIKNGISARMPFYDTLPDMDLVFGKNHLPSLEYGANYFLQLSKINDINRLSTEMLSLYTHDLNKESDISKLFEPYNIKTIKSYGRSIQADAVVVDLRPSNSLYKNEHPYYKSNNYLKENNLYIXDYTMITFEIYRPIFELSTEKTXIIKVPTLFGKTIVNAVRVYXSLFRYVKLYKLSADSWLKDSAIIVXQQPHAANINKFITYIRKVTKSQTWLDSNNVNFILIHDSVERVFIEKFLSFSYKIYESLYYVHSLLYSSMTSDLQSLDNEYQKKLIKLLRG

SEQ ID NO: 227 - protein, 289 aa, Artificial sequence
  Regulatory polypeptide variant all cysteines substituted
  misc_feature (46)..(46): Xaa can be any naturally occurring amino acid, preferably Ala, Ser and Val
  misc_feature (130)..(130): Xaa can be any naturally occurring amino acid, preferably Ala, Ser and Val
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (178)..(178): Xaa can be any naturally occurring amino acid, preferably Ala, Ser and Val
  misc_feature (198)..(198): Xaa can be any naturally occurring amino acid, preferably Ala, Ser and Val
MTEEEQIIRSGFGVTFPHYPALPSLDLVFGKNHLPSLEYGADYFLXLSKVNDLNRISTETLSLYTHGLMAAEDDLERAYASLGVKTVKTHGKTIHADAVVLDMSAYRKLYKTERAAIKSNNELNFNNLFXSNYDMLTFKVFRPLFFIGTEKYXVVKLPTLFGRTVANAVRVYXSVFKXVRLFKSPHDSWFKDSALMIXSGLDAGNLARLLTYLKKATRSNAWKDENDFKNYVLVRPSVEPQFLQVYVGFANPVYRAIFLVHTYLYESINSEAKSVQNEHQEKLLKILYK

SEQ ID NO: 228 - protein, 333 aa, Artificial sequence
  Cap-methyltransferase variant all cysteines substituted
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTADLLSNYALQNVMISILNPVASSLKWRXPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYXNKTFPTTKAKVLFLQQSIFRFLNIPTTSTEKVSHEPIQRKISSKDSMSKNRNSKRSVRGNK

SEQ ID NO: 229 - protein, 333 aa, Artificial sequence
  Cap-methyltransferase variant all cysteines substituted
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTADLLSNYALQNVMISILNPVASSLKWRXPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYXNKTFPTTKAKILFLQQSIFRFLNIPTTSTEKVSHEPIQRKISSKDSMSKNRNSKRSVRGNK

SEQ ID NO: 230 - protein, 333 aa, Artificial sequence
  Cap-methyltransferase variant all cysteines substituted
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRTIKKQLHPSKIILISDVRSKRGGNEPSTADLLSNYALQNVMISILNPVASSLKWRXPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYXNKTFPTTKAKVLFLQQSIFRFLNIPTTSTEKVSHEPIQRKISSKDSVSKNRNSKRSVRGNK

SEQ ID NO: 231 - protein, 333 aa, Artificial sequence
  Cap-methyltransferase variant all cysteines substituted
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKHLHPSKIILISDVRSKRGGNEPSTEDLLSNYALQNVMISILNPVASSLKWRXPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYXNKTFPTTKAKVLFLQQSIFRFLNIPTTSTEKVSHEPIQRKVSSKDSVSKNRNSKRSIRGNK

SEQ ID NO: 232 - protein, 333 aa, Artificial sequence
  Cap-methyltransferase variant all cysteines substituted
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
  misc_feature (276)..(276): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLVDGRHHDPILNGLRDVTLVTRFVDEEYLRSIKKQLHPSKIILISDVRSKRGGNEPSTEDLLSNYALQNIMISILNPVASSLKWRXPFPDQWIKDFYIPHGNKMLQPFAPSYSAEMRLLSIYTGDNMRLTRVTKSDAVNYEKKMYYLNKIVRNKVVVNFDYPNQEYDYFHMYFMLRTVYXNKTXPTTKAKVLFLQQSIFRFLNIPTTSTEKVSHEPIQRKVSSKDSVSKNRNSKRSVRGNK

SEQ ID NO: 233 - protein, 333 aa, Artificial sequence
  Cap-methyltransferase variant all cysteines substituted
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
  misc_feature (311)..(311): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTEDLLSNYALQNVMISILNPVASSLKWRXPFPDQWIKDFYIPHGNKMSQPFAPSYSAEMRLLSIYTGENMRLTRVTKSDAVNYEKKMYYLNKIVRNKVVVNFDYPNQEYDYFHMYFMLRTVYXNKTFPTTKAKVLFLQQSIFRFLNIPTTSTEKVSHEPIQXKVSSKDSVYKNRNSKRSVRGNK

SEQ ID NO: 234 - protein, 333 aa, Artificial sequence
  Cap-methyltransferase variant all cysteines substituted
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
MDVVSLDKPFMYFEEIDNELEYEPESANEVAKKLPYQGQLKLLLGELFFLSKLQRHGILDGATVVYIGSAPGTHIRYLRDHFYNLGVIIKWMLIDGRHHDPVLNGLRDVTIVTRFVDEEYLRTIKKQLHPSKIILISDVRSKRGGNEPSTADLLSNYALQNIMVSILNPVASSLKWRXPFPDQWIKDFYIPHGNKMLQPFAPSYSAEMRLLSIYTGENMRLTRVTSSDAINYEKKMYYLNKIVRNRVVVNFDYPNQEYDYFHMFFMLRTVYXNKTFPNTKAKVLFLQQSIFRFLNIPTTSTEKVSHEPVQRKISSKDSVSKNRNSKRSVRGNK

SEQ ID NO: 235 - protein, 333 aa, Artificial sequence
  Cap-methyltransferase variant all cysteines substituted
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MDVVSMDKPFMYFEEIDGMLDYEHSSADEVAKKLPYQGQLKLLLGELFFLSKLQRHGILDGATVLYIGSAPGTHIRYLRDHFYNLGVIIKWMLIDGRHHNSILNGLRDVILITRFVDEDYLRILKKQLHPSKIILISDIRSKRRSGEPTTEDLLSNYALQNIMISILNPVASSLKWRXPFPDQWIKDFYIPHGNKMLQPFAPSYSAEMRLLSIYTSDAVRLTXVTKSDAINYEKKMYYLNKIVRNRVVVNFDYTNQEYDYFHMYYILRTIYTNKTFPTTKSKVLFLQQSIFRFLNIPTTTTEKIHYEPAQRKIPGKNIVSKNRNNTRPVRYNK

SEQ ID NO: 236 - protein, 347 aa, Artificial sequence
  Cap-methyltransferase variant all cysteines substituted
  misc_feature (59)..(59): Xaa can be any naturally occurring amino acid, preferably Ala, Ser and Val
  misc_feature (115)..(115): Xaa can be any naturally occurring amino acid, preferably Ala, Ser and Val
  misc_feature (192)..(192): Xaa can be any naturally occurring amino acid, preferably Ala, Ser and Val
  misc_feature (237)..(237): Xaa can be any naturally occurring amino acid, preferably Ala, Ser and Val
MIKLLKRRSKSTFKMEAISMDKPFMYFDEIDNELEYDPKSAEEKPKKLPYQGQLKLLLXELFFLSKLQRHGILDGATIIYIGSAPGTHIKYIRDHFLSMGLIIKWILIDGRKHDXILEGLRDVQLITKFVDESYIKFLKKKTFPSKIILISDVRSKRGGSEPSTNDLLSNYALQNIMVTILKPVASSLKWRXPFPDQWIKDFYIPYGNEMLQPFAPKYSAELRLISIYSGDPIKLRXITKEDALKYEKKMYYLNKVVRNKIVINFDYSNQEYDFFHMYHMLRTIYSNKPFISIKAKVLYFHQSIFKFLKIPLTYTEKINNEPTQRKISSKNTLSKNRSTKKSLRDNK

SEQ ID NO: 237 - protein, 333 aa, Artificial sequence
  Cap-methyltransferase variant all cysteines substituted
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
  misc_feature (311)..(311): Xaa can be any naturally occurring amino acid, preferably Ala, Ser and Val
MDAVSMEKPIMYLDEIDNELKYDPNSANEKNKKFPFQGQLKLLLGELFFLSKLQRHGILDGSTVLYIGSAPGTHIRYLRDHFISMGLVIKWMLIDGRHHDIILNGLRDVSLITRFVDESYIKLLKKQLYPSKIILISDIRSKRGGNEPSTEDLLSNYALQNIMVSVLQPVASSLKWRXPFPDQWLRDFYVPYGNEMLQPFAPLYSAELRLITIYSGEPIKLRXITINDAKKYEKKMFYVNKVIRNKIILNFDYPNQEYDFFHMYFMLKTVYYNKEFSSTKEKVLFFHQSIFKFLKIPIINTEKVNHEQPQXKVFGKNFMSKGGNNERSVRDNK

SEQ ID NO: 238 - protein, 338 aa, Artificial sequence
  Cap-methyltransferase variant all cysteines substituted
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MEPVSMDKPFMYFDEIDDELEYEPESVNETPKKLPHQGQLKLLLGELFFLSKLQRHGILDGSTIVYIGSAPGTHIKYLRDHFMSMGLVIKWMLIDGRTHDPILEGLRDVILITKFVDEAYIRQLKKQLYPSRVILISDVRSKRGQKEPTTQDLLSNYSLQNIMVSVLKPAASSLKWRXPFPDQWIKDFYVPHGNEMLQPFAPSYSAEMRLLSIYSGTPIRLKXITQQDSSKYEKKMYYLNKIIRNRIIINFDYSNQEYDFFHMYHMLKTVYSNKSFTSNKSKVLHFHQSIFRFLKIPITNTEKIHHEPTQRKVPSKNTMLKSRNTKKSVRGNKQGRRT

SEQ ID NO: 239 - protein, 363 aa, Artificial sequence
  Cap-methyltransferase variant all cysteines substituted
  misc_feature (208)..(208): Xaa can be any naturally occurring amino acid, preferably Ala, Ser and Val
  misc_feature (253)..(253): Xaa can be any naturally occurring amino acid, preferably Ala, Ser and Val
  misc_feature (341)..(341): Xaa can be any naturally occurring amino acid, preferably Ala, Ser and Val
MIHLTTTNFFKKYINYNLIKVRLLNIQHLKMDAVSMEKPIMYLDETNSEMDYDPNSANEKNKKFPFQGQLKLLLGELFFLSKLQRHGILDGSTVLYIGSAPGTHIRYLRDHFISMGLVIRWMLIDGRQHDIILNGLRDVSLITRFVDESYIKLLKKQLHNSKIILISDIRSKRGGNEPSTEDLLANYALQNIMVSVLQPIASSLKWRXPFPDQWLRDFYIPYGNEMLQPFAPAYSAELRLITIYSGEPIKLRXITKNDAKKYEKKMFYINKVIRNKIILNFDYPNQEYDFFHMYFMLKTVYYNKEFSSVKEKVLFFHQSIFRFLKIPIINTEKVKHEQSQXKIPGKNSMFKSGNIERPIRNNK

SEQ ID NO: 240 - protein, 333 aa, Artificial sequence
  Cap-methyltransferase variant all cysteines substituted
  misc_feature (45)..(45): Xaa can be any naturally occurring amino acid, preferably Ala, Ser and Val
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MEPLSIDKPFMYFDEINNELEYDPDSANEKHKKFPYQGQLKLLLXELFFLSKLQRHGILDGSTIVYIGSAPGTHIRYLRNHFVSMGLVIRWILIDGRKHDYILEGIRDITLITKFVDENYIRQLKKQLYPSKIILISDIRSKRGTSEPTTSDLLNNYTLQNIMVSILKPVASSLKWRXPFPDQWIKDFYIPYGNELLQPFAPTYSAEMRLISIYNNEPIRLRXITKEDALKYEKKMYYLNKIIRSKIVINFDYPNQEYDVFHMYHMLKTVYTNKNFISVKDKVLFIHQSIFKFLKIPITYSEKIRYEPTQRKVSSKDTMSKDRNIKKSVLGDK

SEQ ID NO: 241 - protein, 338 aa, Artificial sequence
  Cap-methyltransferase variant all cysteines substituted
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
  misc_feature (311)..(311): Xaa can be any naturally occurring amino acid, preferably Ala, Ser and Val
MEPVSMDKPFMYFDEIEDELEYEPESVNETPKKLPHQGQLKLLLGELFFLSKLQRHGILDGSTIVYIGSAPGTHIKYLRDHFVSMGLVIKWMLIDGRTHDTILEGLRDVILITKFVDEAYIRQLKKQLYPSRVILISDVRSKRGKKEPTTQDLLSNYSLQNIMVSVLKPAASSLKWRXPFPDQWIKDFYVPHGNEMLQPFAPSYSAEMRLLSIYSGTPIRLKXITQQDSLKYEKKMYYLNKIIRNRIIINFDYSNQEYDFFHMYHMLKTVYSNKSFTSNKSKVLHLHQSIFRFLKIPITNTEKIHHEPTQXKVSSKNTMLKSRNTKKPVRGNKQGRRT

SEQ ID NO: 242 - protein, 333 aa, Artificial sequence
  Cap-methyltransferase variant all cysteines substituted
  misc_feature (45)..(45): Xaa can be any naturally occurring amino acid, preferably Ala, Ser and Val
  misc_feature (62)..(62): Xaa can be any naturally occurring amino acid, preferably Ala, Ser and Val
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MEAVSMDKPFMYFDEIDNELEYDPKTSEEKPKKLPYQGQLKLLLXELFFLSKLQRHGILDGXTIVYVGSAPGTHIKYLRDHFLSMGLVIRWILIDGRQHDTILNGLRDVTLITKFVDESYIRVLKKQLYQSKIVLISDVRSKRGGNEPSTFDLLSNYALQNIMVSILKPAASSLKWRXPFPDQWVKDFYIPHGNEMLQPFAPKYSAEMRLISIYSGNPIKLRXITKDDSIKYEKKMFYFNKIIRNRIIINFDYSNQEYDFYHMYNMLKTVYSNKDFSSIKSKVLFFHHSIFKFLKIPIFNTEKINYEPAQRKILSKNIMFKNRNIKKSIRYNK

SEQ ID NO: 243 - protein, 333 aa, Artificial sequence
  Cap-methyltransferase variant all cysteines substituted
  misc_feature (45)..(45): Xaa can be any naturally occurring amino acid, preferably Ala, Ser and Val
  misc_feature (62)..(62): Xaa can be any naturally occurring amino acid, preferably Ala, Ser and Val
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MEAVSMDKPFMYFDEIDNELEYDPKTSEEKPKKLPYQGQLKLLLXELFFLSKLQRHGILDGXTIVYVGSAPGTHIKYLRDHFLSMGLVIRWILIDGRQHDTILNGLRDVTLITKFVDESYIRVLKKQLYKSKIVLISDVRSKRGGNEPNTFDLLSNYALQNIMVSILKPAASSLKWRXPFPDQWVKDFYIPHGNEMLQPFAPKYSAEMRLISIYSGNPIKLRXITKDDSIKYEKKMFYFNKIIRNRIIINFDYSNQEYDFYHMYNMLKTVYSNKDFSSIKSKVLFFHHSIFKFLKIPIFNTEKINYEPTQRKILSKNIMFKNRNIKKSIRYNK

SEQ ID NO: 244 - protein, 333 aa, Artificial sequence
  Cap-methyltransferase variant all cysteines substituted
  misc_feature (45)..(45): Xaa can be any naturally occurring amino acid, preferably Ala, Ser and Val
  misc_feature (62)..(62): Xaa can be any naturally occurring amino acid, preferably Ala, Ser and Val
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MEAVSMDKPFMYFDEIDNELEYDPKTSEEKPKKLPYQGQLKLLLXELFFLSKLQRHGILDGXTIVYVGSAPGTHIKYLRDHFLSMGLVIRWILIDGRQHDTILNGFRDVTLITKFVDESYIRVLKKQLYQSKIVLISDVRSKRGGNEPSTFDLLSNYALQNIMVSILKPAASSLKWRXPFPDQWVKDFYIPHGNEMLQPFAPKYSAEMRLISIYSGNPIKLRXITKDDSIKYEKKMFYFNKIIRNRIIINFDYSNQEYDFYHMYNMLKTVYSNKDFSSIKSKVLFFHHSIFKFLKIPIFNTEKINYEPSQRKILSKNIMFKNRNIKKSIRYNK

SEQ ID NO: 245 - protein, 333 aa, Artificial sequence
  Cap-methyltransferase variant all cysteines substituted
  misc_feature (101)..(101): Xaa can be any naturally occurring amino acid, preferably Ala, Ser and Val
  misc_feature (178)..(178): Xaa can be any naturally occurring amino acid, preferably Ala, Ser and Val
  misc_feature (254)..(254): Xaa can be any naturally occurring amino acid, preferably Ala, Ser and Val
  misc_feature (311)..(311): Xaa can be any naturally occurring amino acid, preferably Ala, Ser and Val
MEPVSMENPLIYFDDIDDELEYDPNSSMEPIKKIPYQGQLKLLLGELFFLTKLQKHGILDGSTVVYIGSAPGIHIKYIRDHFLSMSVIIKWLLIDGRQHDXNLEGLRDVTVITKFVDETYIRKLQKKLYPSKIILISDIRSIRGGNEPNTYDLLNNYVLQNVMVSILKPVASSLKWRXPFPDQWVKDFYIPYGTEMLQPFAPKYSAEMRLITIYNNDPIKLRLITKKDAIKYEKKMYYFNKIVRNRIVINFDYXNQEYDFYHMYYILKTIYTNKVFTDIKSKVLYLHQSIFKFLKIPISSTEKIHYEPTQXKVSGKNIMSKNRSVKKSIRYNK

SEQ ID NO: 246 - protein, 334 aa, Artificial sequence
  Cap-methyltransferase variant all cysteines substituted
  misc_feature (179)..(179): Xaa can be any naturally occurring amino acid, preferably Ala, Ser and Val
  misc_feature (193)..(193): Xaa can be any naturally occurring amino acid, preferably Ala, Ser and Val
  misc_feature (224)..(224): Xaa can be any naturally occurring amino acid, preferably Ala, Ser and Val
  misc_feature (273)..(273): Xaa can be any naturally occurring amino acid, preferably Ala, Ser and Val
MNAEHMDRPYIYFDQLDGTRDYDSEKEASRKSERMPSQGQLKLLLGELFFLSKLQRYGLLDGSNIVYVGSAPGTHIRFLRDHFADLGVTLKWTLIDGRRHDGSLRGLRDVTLVTRFADEEYTRSLRRHLRGARVILISDVRSKRGGDEPSTEDLLRDYALQNTIVSILNPAAFSLKWRXPFPGQWVRDFYVPXGKEMLQAFAPPYSAELRILSISTGEPVKLRXINLDTASDYEKKMFFFNDVVRRRVVVNFDYPNQEYDYYHMYYLLRNVFXEKEFPSTKAKVLFLHHKIFKFLNIPLSPTERLRDEPVQRPLPSKDPVPEGGDRARPVRGDK

SEQ ID NO: 247 - protein, 337 aa, Artificial sequence
  Cap-methyltransferase variant all cysteines substituted
  misc_feature (77)..(78): Xaa can be any naturally occurring amino acid, preferably Ala, Ser and Val
  misc_feature (103)..(103): Xaa can be any naturally occurring amino acid, preferably Ala, Ser and Val
  misc_feature (179)..(179): Xaa can be any naturally occurring amino acid, preferably Ala, Ser and Val
  misc_feature (193)..(193): Xaa can be any naturally occurring amino acid, preferably Ala, Ser and Val
  misc_feature (273)..(273): Xaa can be any naturally occurring amino acid, preferably Ala, Ser and Val
MEGVEMEKPLLYFDELTGERDFDAAFAEANEPAKLPAQGQLKLLVGELVFLNRLYRHGMLDGSVIVYIGSAPGTHIXXLHSHFQELGVSLKWILVDGRKHDAXLMGLRNVTTVTRFADEAYLRELRAELKRAKVVLISDIRSNRVNTEPTTADLLRDYALQNVMVSVLKPIASSLKWRXPFPDSWEKDFYVPXGKEMLQPFAPPFSAEMRLLSVYADTPARLRLVTLSDAVKYEKRMFYLNSVVRRRVILNFDYPNQEYDFFHMFYLLSSVVXSKEFKSAKDKVLSLQQGFFRFLRIPAISTPGLRAPDDEPAQRAVPGKNSLPKGRGKKRSVRDHK

SEQ ID NO: 248 - protein, 337 aa, Artificial sequence
  Variant of the enzyme, all Cysteines substituted
  misc_feature (77)..(78): Xaa can be any naturally occurring amino acid, preferably Ala, Ser and Val
  misc_feature (103)..(103): Xaa can be any naturally occurring amino acid, preferably Ala, Ser and Val
  misc_feature (179)..(179): Xaa can be any naturally occurring amino acid, preferably Ala, Ser and Val
  misc_feature (193)..(193): Xaa can be any naturally occurring amino acid, preferably Ala, Ser and Val
  misc_feature (273)..(273): Xaa can be any naturally occurring amino acid, preferably Ala, Ser and Val
  misc_feature (315)..(315): Xaa can be any naturally occurring amino acid, preferably Ala, Ser and Val
MEGVEMEKPLLYFDDIAGERDFDAAFAAENEPPKMPAQGQLKLLVGELVFLNRLYKHGLLDGSVIVYVGSAPGTHIXXLHSHFQELGVSLKWVLIDGRKHDSXLMGLRNVTTVTRFADEAYLRELKSSMRRSKIVLISDIRSNRVNTEPTTADLLRDYALQNVMVSVLRPIASSLKWRXPFPDSWERDFYVPXGKEMLQPFAPPFSAEMRLLTVHAETPARMRLVTLADAVRYEKRMFFLNSVVRRRVILNFDYPNQEYDFFHMFHLLSTVVXSREFKSAKDKVLSLQQSFFRFLRIPPLPTPGLRAPRDEPAQXAVPGKDPLPKGRGKKRPVRGDK

SEQ ID NO: 249 - protein, 336 aa, Artificial sequence
  Cap-methyltransferase variant all cysteines substituted
  misc_feature (46)..(46): Xaa can be any naturally occurring amino acid, preferably Ala, Ser and Val
  misc_feature (77)..(78): Xaa can be any naturally occurring amino acid, preferably Ala, Ser and Val
  misc_feature (103)..(103): Xaa can be any naturally occurring amino acid, preferably Ala, Ser and Val
  misc_feature (179)..(179): Xaa can be any naturally occurring amino acid, preferably Ala, Ser and Val
  misc_feature (193)..(193): Xaa can be any naturally occurring amino acid, preferably Ala, Ser and Val
  misc_feature (266)..(266): Xaa can be any naturally occurring amino acid, preferably Ala, Ser and Val
  misc_feature (273)..(273): Xaa can be any naturally occurring amino acid, preferably Ala, Ser and Val
  misc_feature (275)..(275): Xaa can be any naturally occurring amino acid, preferably Ala, Ser and Val
MEGVEMDKPLLYFDEIAGAREYDAAFAEKHEPPKIPGRGQMKLLVXELVFLNRLHLHGMLDGSVIVYVGSAPGRHIXXLHSHFQELGVSLKWVLIDGRKHDPXLSGLRNVTTVTRFADEAYLRELRGELRRSKIVLISDIRSNRVDTEPTTADLLRDYALQNTMVSVLKPVASSLKWRXPFPDSWEKDFYVPXGKEMLQPFAPPFSAEMRLLTVYSETRPKLRLITLSDAVNYEKRMFYLNSVVRQRVILNFDYPNQEYDFFHMFXLLSSVVXSXEFKSPKEKVLSLQNRFFRFLRIPPSITLGLRQHDEPPQHAVPGQDPLPKGRGKKRPLRGGK

SEQ ID NO: 250 - protein, 342 aa, Artificial sequence
  Cap-methyltransferase variant all cysteines substituted
  misc_feature (177)..(177): Xaa can be any naturally occurring amino acid, preferably Ala, Ser and Val
  misc_feature (191)..(191): Xaa can be any naturally occurring amino acid, preferably Ala, Ser and Val
  misc_feature (221)..(221): Xaa can be any naturally occurring amino acid, preferably Ala, Ser and Val
  misc_feature (270)..(270): Xaa can be any naturally occurring amino acid, preferably Ala, Ser and Val
MEAQAMERPLLYFHELTQTQEYDAEVERAARSRFPAQGQLKLLIGELFFLNKLHRREMLAGTTVVYIGSAPGGHIRYLVEHFRALGVPLRWMLLDGRSHDSRLQGLSDVTLVTRFVDERYLMRMRQALRGARVVLISDIRSRRGSEPSTEDLLYDYALQNSMLSILKPVASSLKWRXPFPDQWLHNFYVVXGKELLQPFAPPFSAELRLLSVHAGAPRLRXITLAAARDYEKKMFYLNNVIRRRIVLNFDYPNQEYDFFHMFHLLNTVLXPRSFDSPTKKVLFLQQSIFRFLGIQSPLPEKLPLPERPRKHEPAQRGVPGQDPVSEGRGRAKPVRGRQQGAP

SEQ ID NO: 251 - protein, 336 aa, Artificial sequence
  Cap-methyltransferase variant all cysteines substituted
  misc_feature (46)..(46): Xaa can be any naturally occurring amino acid, preferably Ala, Ser and Val
  misc_feature (77)..(78): Xaa can be any naturally occurring amino acid, preferably Ala, Ser and Val
  misc_feature (103)..(103): Xaa can be any naturally occurring amino acid, preferably Ala, Ser and Val
  misc_feature (179)..(179): Xaa can be any naturally occurring amino acid, preferably Ala, Ser and Val
  misc_feature (193)..(193): Xaa can be any naturally occurring amino acid, preferably Ala, Ser and Val
  misc_feature (266)..(266): Xaa can be any naturally occurring amino acid, preferably Ala, Ser and Val
  misc_feature (273)..(273): Xaa can be any naturally occurring amino acid, preferably Ala, Ser and Val
  misc_feature (275)..(275): Xaa can be any naturally occurring amino acid, preferably Ala, Ser and Val
MEGVEMEKPLLYFDEIAGARDYDAAFAERHEPAKIPGRGQMKLLVXELVFLNRLHLHGMLDGSVIVYVGSAPGRHIXXLHSHFQELGVSLKWVLIDGRKHDPXLSGLRNVTTVTRFADEAYLRELRADLRRAKIVLISDIRSNRVDTEPTTADLLRDYALQNTMVSVLKPVASSLKWRXPFPDSWEKDFYVPXGKEMLQPFAPPFSAEMRLLTVYSETRPKLRLITLSDAVNYEKRMFYLNSVVRQRVILNFDYPNQEYDFFHMFXLLSSVAXSXDFKSPKEKVLSLQNRFFRFLRIPPSITLGLRRHDEPPQHAVPGQDPLPKGRGKRRPLRGDK

SEQ ID NO: 252 - protein, 302 aa, Artificial sequence
  Cap-methyltransferase variant all cysteines substituted
  misc_feature (28)..(28): Xaa can be any naturally occurring amino acid, preferably Ala, Ser and Val
  misc_feature (30)..(30): Xaa can be any naturally occurring amino acid, preferably Ala, Ser and Val
  misc_feature (178)..(178): Xaa can be any naturally occurring amino acid, preferably Ala, Ser and Val
MNVIELSKPFIFYDELVHRLDYDKAIEXSXKAKFQGQGQLKLLLGELYFLNTLLRNNMLYSDMVIVYIGSAPGSHIKFLYSHLESLGIRLKWILIDGRDHDSSLSTLRNVTIIKRFVDEQYLFKLHEKLKKEKVILISDIRSLRGKEPTSEDLLHDYSLQNLMISILRPIASSLKWRXPFPDQWIRDFYIPLGDEFLQPFAPSYSAEMRLLGSYTRGPIRLIRITREAAVEYEKKMFYLNNKVRKSIVLDFDYPRQEYDFFHMFYILKDLIVSESLEFTTDKQKVIFLQDSIFKSLNIKPTP

SEQ ID NO: 253 - protein, 300 aa, Artificial sequence
  Cap-methyltransferase variant all cysteines substituted
  misc_feature (18)..(18): Xaa can be any naturally occurring amino acid, preferably Ala, Ser and Val
  misc_feature (30)..(30): Xaa can be any naturally occurring amino acid, preferably Ala, Ser and Val
  misc_feature (36)..(36): Xaa can be any naturally occurring amino acid, preferably Ala, Ser and Val
  misc_feature (60)..(60): Xaa can be any naturally occurring amino acid, preferably Ala, Ser and Val
  misc_feature (178)..(178): Xaa can be any naturally occurring amino acid, preferably Ala, Ser and Val
MNILDAERPFMFYNELTXKQDYNKNIESSXKNKFPXQGQLKLLIGEIYFLNRLIKEDILXSNTVIIYIGSAPGNHIKFLHNYLNSINIYPKWILIDGRDHEASLEGLKDVTIVQRFVDEPYLFKLRNITKKDKVVLISDIRSLRGKEPTTEDLLHDYALQNMMISILAPVASSLKWRXPFPEQWLDDFYIPYGEEFLQPFAPTFSAEMRILGIYVKAPIRLLRINKDIALEYEKKMFYLNNIIRRSIVLDFDYPIQDYDFFHMFHILKDIVIPESLQFLTDKQKVIFLQDSIFKSLNIRK

SEQ ID NO: 254 - protein, 308 aa, Artificial sequence
  Cap-methyltransferase variant all cysteines substituted
  misc_feature (67)..(67): Xaa can be any naturally occurring amino acid, preferably Ala, Ser and Val
  misc_feature (186)..(186): Xaa can be any naturally occurring amino acid, preferably Ala, Ser and Val
  misc_feature (200)..(200): Xaa can be any naturally occurring amino acid, preferably Ala, Ser and Val
  misc_feature (221)..(221): Xaa can be any naturally occurring amino acid, preferably Ala, Ser and Val
MHEGHQESFKELEMTKPYMFFNELVGEEDYNKELENSNTKFQGQGQLKLLLGELYFLNTLIKNKTLXSDTVIVYIGSAPGSHINFLYHYMDDLKIDLKWILIDGRDHDRSLESLKNVSIIHRFVDEQYLFKLRNMIRKNHKIVLISDIRSLRGKEPTSEDLLHDYALQNQMVSILKPIASSLKWRXPFPDQWIRDFYIPXGDEFLQPFAPPFSAEMRLLSXYSRAPIRLIRIDKNAAIEYEKKMFYLNTKIRPKIVLDFDYPNQKYDYFYMFYILKDIVLPTYKEFSTYKQKVIFLQEAIFNALNIKP

SEQ ID NO: 255 - protein, 308 aa, Artificial sequence
  Cap-methyltransferase variant all cysteines substituted
  misc_feature (67)..(67): Xaa can be any naturally occurring amino acid, preferably Ala, Ser and Val
  misc_feature (186)..(186): Xaa can be any naturally occurring amino acid, preferably Ala, Ser and Val
  misc_feature (200)..(200): Xaa can be any naturally occurring amino acid, preferably Ala, Ser and Val
  misc_feature (221)..(221): Xaa can be any naturally occurring amino acid, preferably Ala, Ser and Val
MHEGRKDTFKELEMTKPYMFFNELVGEEDYNKALEGSNTKFQGQGQLKLLLGELYFLNILIKNKTLXSDTVIVYIGSAPGSHINFLYHYMDDLKIDLKWILIDGRDHDQSLENLKNVSIIHRFVDEQYLFKLRNMIRKNNKIVLISDIRSLRGKEPTSEDLLHDYALQNQMVSILKPIASSLKWRXPFPDQWIRDFYIPXGDEFLQPFAPPFSAEMRLLSXYSRAPIRLIRIDKNAAIEYEKKMFYLNTKIRPKIVLDFDYPNQKYDYFYMFYILKDIVLPTSKEFSTYKQKVIFLQESIFTALNIKP

SEQ ID NO: 256 - protein, 294 aa, Artificial sequence
  Cap-methyltransferase variant all cysteines substituted
  misc_feature (176)..(176): Xaa can be any naturally occurring amino acid, preferably Ala, Ser and Val
  misc_feature (243)..(243): Xaa can be any naturally occurring amino acid, preferably Ala, Ser and Val
MAGTISMPKPYLFFSDLSGEEEYSADYEQRRFRSQGQLKLLLGELYFLDQLSKAGTLSGSPTVVYIGSAPGTHIRYLRDHFAKLGYELRWVLIDGREHDASLRGLPDVELVTRFVNEAYLHRLRAKLGDRAVVLISDIRAVRDGEPRTEDMLEDYRLQNKMVEVLKPVAFSLKWRXPFPDQWTKDFVVIKGAEFLQPFRPSYSTEMRLLSLNGRPLTIRHVTLDAAKEYERKLFYLNHRVRRXTVLSFDFYNQGYDYFHAYWLLKDLSYPAVFQSEKIKAAFLLQEIFDFLGIK

SEQ ID NO: 257 - protein, 311 aa, Artificial sequence
  Cap-methyltransferase variant all cysteines substituted
  misc_feature (16)..(16): Xaa can be any naturally occurring amino acid, preferably Ala, Ser and Val
  misc_feature (83)..(83): Xaa can be any naturally occurring amino acid, preferably Ala, Ser and Val
  misc_feature (183)..(183): Xaa can be any naturally occurring amino acid, preferably Ala, Ser and Val
  misc_feature (191)..(191): Xaa can be any naturally occurring amino acid, preferably Ala, Ser and Val
  misc_feature (250)..(250): Xaa can be any naturally occurring amino acid, preferably Ala, Ser and Val
  misc_feature (299)..(299): Xaa can be any naturally occurring amino acid, preferably Ala, Ser and Val
  misc_feature (310)..(310): Xaa can be any naturally occurring amino acid, preferably Ala, Ser and Val
MSANHKKFKSLTLETXPIMSFDQITKQLKWEKNMDKTVFPHKTNGQLKLLLGELLFFTEITRDTPLFNRENVNSFVVVYVGSXPGFHVPAIDYFFPGLTWELIDPTPMSVTLEKYVHRHKNRYTYTRDYADVKWAQHVVDKYPGKKIVLISDIRTSGDGEPTTQNLLDDYDLQEAIIKKLKPXAWMLKWRXPFPDSWPTTKEVKIPVGKIYVQAFAKPTSAELRIVNLTGNLTTNVVTKQEGVIYEEKMXYFNQVLRRSQITNGLYDLIFHDKLYAFEIATRIFNYAWTTHAPVLGRTXDKIYHIYTALXK

SEQ ID NO: 258 - protein, 295 aa, Artificial sequence
  Cap-methyltransferase variant all cysteines substituted
  misc_feature (53)..(53): Xaa can be any naturally occurring amino acid, preferably Ala, Ser and Val
  misc_feature (101)..(101): Xaa can be any naturally occurring amino acid, preferably Ala, Ser and Val
  misc_feature (202)..(202): Xaa can be any naturally occurring amino acid, preferably Ala, Ser and Val
MSIYMKINDFKKPNVLIFDNINNQLKYKPNNVSNKHPGQLKLLMTELQFFNNXNIDALNSKDRPIYVLYIGSGRGYHLIKLLDLYKDYNIKWYFYDPSGHXISLERMSQYVSINNDYFTEKNINEFKNKKPLLFISDIRSTDGSEPRTKNLIDDYKIQNNIVLNLRPLYSLLKFRYPFPDDFPPEIENEVYVDGIKFLQPFXGPQSTEMRIFVSEQNIILKNFSKEESILFEEKMYYYNKNYRIINKNDILIAGFILKSTNKFDNMKYIDIIKSLENSINNQIREDISFNKLDIK

SEQ ID NO: 259 - protein, 266 aa, Artificial sequence
  Cap-methyltransferase variant all cysteines substituted
  misc_feature (182)..(182): Xaa can be any naturally occurring amino acid, preferably Ala, Ser and Val
MNFPLYLNNAIFKSNNKINIDKLPLIGSLKNYLMMKMFIEKYVHTQDVTIIIIGSAPGMSITEIIIEYPYINFELYDNKQHAPLLYNFNNVKIYNKLFSLYDIKKYIDKNIYVYSDLRTNSKDVNLYNDIYNQHKFILHLNPISAMYKVKLPHINTNYKYIKLPIGIDIIQPFAEHTREYRXVQFKNNYRLNYYKIDTAIDYVAKLNYYNNISLLDKTINYKYAKYILKVNNIRHHITRLLYNFNKRKPLNNKRKIFIMNMKQMLY

SEQ ID NO: 260 - protein, 258 aa, Artificial sequence
  Cap-methyltransferase variant all cysteines substituted
  misc_feature (182)..(182): Xaa can be any naturally occurring amino acid, preferably Ala, Ser and Val
MNFPLYLNNAIFKSNNKINIDKLPLIGSLKNYLMMKLFIEKYVHTQDVTIIIIGSAPGMSITEIIVEYPYINFELYDNKQHAPLLYNFNNVKIHNKLFSLYDINKYIDKNIYVYSDLRTNSKDINLYNDIYNQHKFILHLNPISAMYKVKLPHISTNYKYIKLPIGIDIIQPFAEHTREYRXVQFKNKYRLRYYNIDTAIDYVTKLNYYNNISLLDKTINYKYAKYILKVNNIRHHITRLLYNFNKRKPLNNKRKILL

SEQ ID NO: 261 - protein, 847 aa, Artificial sequence
  Catalytic polypeptide variant, all Cys substituted, Terminal introduced Cys
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (342)..(342): Xaa can be any naturally occurring amino acid, preferably Ala, Ser and Val
  misc_feature (458)..(458): Xaa can be any naturally occurring amino acid, preferably Ala, Ser and Val
  misc_feature (582)..(582): Xaa can be any naturally occurring amino acid, preferably Ala, Ser and Val
  misc_feature (825)..(825): Xaa can be any naturally occurring amino acid, preferably Ala, Ser and Val
MDANIVSSSTIATYIDALAKNASELEQRSTAYEINNELELVFIKPPLITLTNVVNISTIQESFIRFTVTNKEGIKIRTKIPLSKVHGLDVKNVQLVDAIDNIVWEKKSLVTENRLHKEXLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSKGLYXYFTHLGYIIRYPVKRTIDSEVVVFGEAVKDKNWTVYLIKLIEPVNAISDRLEESKYVESKLVDIXDRIVFKSKKYEGPFTTTSEVVDMLSTYLPKQPEGVILFYSKGPKSNIDFKIKKENTIDQTANVVFRYMSSEPIIFGESSIFIEYKKFTNDKGFPKEYGSGKIVLYNGVNYLNNIYXLEYINTHNEVGIKSVVVPIKFIAEFLVNGEILKPRIDKTMKYINSEDYYGNQHNIIVEHLRDQSIKIGDVFNEDKLSDIGHQYAANNDKFRLNPEVSYFTNKRTRGPLGILSNYVKTLLISMYXSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKXEGLDVEDLLSYYVVYVFSKRCC

SEQ ID NO: 262 - protein, 845 aa, Artificial sequence
  Catalytic polypeptide variant, all Cys substituted, Terminal introduced Cys
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (342)..(342): Xaa can be any naturally occurring amino acid, preferably Ala, Ser and Val
  misc_feature (458)..(458): Xaa can be any naturally occurring amino acid, preferably Ala, Ser and Val
  misc_feature (581)..(581): Xaa can be any naturally occurring amino acid, preferably Ala, Ser and Val
  misc_feature (824)..(824): Xaa can be any naturally occurring amino acid, preferably Ala, Ser and Val
MDANVISSSTIATYIDALAKNASELEQGSTAYEINNELELVFIKPPLITLTNVVNISTIQESFIRFTVTNKEGVKIRTKIPLSKVHGLDVKNVQLVDAIDNIVWEKKSLVTENRLHKEXLLRLSTEERHIFLDYKKYGSSIRLELVNLIQAKTKNFTIDFKLKYFLGSGAQSKSSLLHAINHPKSRPNTSLEIEFTPRNNETVPYDELIKELTTLSRHIFMASPENVILSPPINAPINTFMLPKQDIVGLDLENLYAVTKTDGIPITIRVTSKGLYXYFTHLGYIIRYPVKRIIDSEVVVFGEAVKDKNWTVYLIKLIEPVNAISDRLEESKYVESKLVDIXDRIVFKSKKYEGPFTTTSEVVDMLSTYLPKQPEGVILFYSKGPKSNIDFKIKKENTIDQTANVVFRYMSSEPIIFGESSIFIEYKKFTNDKGFPKEYGSGKIVLYNGVNYLNNIYXLEYINTHNEVGIKSVVVPIKFIAEFLVNGEILKPRIDKTMKYINSEDYYGNQHNVIVEHLRDQSIKIGDVFNEDKLSDVGHQYANNDKFRLNPEVSYFTNKRTRGPLGILSNYVKTLLISMYXSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKXEGLDVEDLLSYYVVYVFSKRC

SEQ ID NO: 263 - protein, 845 aa, Artificial sequence
  Catalytic polypeptide variant, all Cys substituted, Terminal introduced Cys
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (342)..(342): Xaa can be any naturally occurring amino acid, preferably Ala, Ser and Val
  misc_feature (458)..(458): Xaa can be any naturally occurring amino acid, preferably Ala, Ser and Val
  misc_feature (581)..(581): Xaa can be any naturally occurring amino acid, preferably Ala, Ser and Val
  misc_feature (824)..(824): Xaa can be any naturally occurring amino acid, preferably Ala, Ser and Val
MDANVVSSSTIATYIDALAKNASELKQGSTAYEINNELELVFIKPPLITLTNVVNISTIQESFIRFTVTNKEGVKIRTKIPLSKVHGLDVKNVQLVDAIDNIVWEKKSLVTENRLHKEXLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPINTFMLPKQDIVGLDLENLYAVTKTDGIPITIRVTSKGLYXYFTHLGYIIRYPVKRIIDSEVVVFGEAVKDKNWTVYLIKLIEPVNAISDRLEESKYVESKLVDIXDRIVFKSKKYEGPFTTTSEVVDMLSTYLPKQPEGVILFYSKGPKSNIDFKIKKENTIDQTANVVFRYMSSEPIIFGESSIFIEYKKFTNDKGFPKEYGSGKIVLYNGVNYLNNIYXLEYINTHNEVGIKSVVVPIKFIAEFLVNGELLKPRIDKTMKYINSEDYYGNQHNVIVEHLRDQSIKIGDIFNEDKLSDVGHQYANNDKFRLNPEVSYFTNKRTRGPLGILSNYVKTLLISMYXSKTFLDDSNKRKVLAIDFGNGADLEKYFYGEIALLVATDPDADAIARGNERYNRLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKXEGLDVEDLLSYYVVYVFSKRC

SEQ ID NO: 264 - protein, 845 aa, Artificial sequence
  Catalytic polypeptide variant, all Cys substituted, Terminal introduced Cys
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (342)..(342): Xaa can be any naturally occurring amino acid, preferably Ala, Ser and Val
  misc_feature (458)..(458): Xaa can be any naturally occurring amino acid, preferably Ala, Ser and Val
  misc_feature (581)..(581): Xaa can be any naturally occurring amino acid, preferably Ala, Ser and Val
  misc_feature (824)..(824): Xaa can be any naturally occurring amino acid, preferably Ala, Ser and Val
MDANVVSSSTIATYIDALAKNASELEQGSTAYEINNELELVFIKPPLITLTNVVNISTIQESFIRFTVTNKEGVKIRTKIPLSKVHGLDVKNVQLVDAIDNIVWEKKSLVTENRLHKEXLLRLSTEERHIFLDYKKYGSSIRLELVNLIQAKTKNFTIDFKLKYFLGSGAQSKSSLLHAINHPKSRPNTSLEIEFTPRDNEKVPYDELIKELTTLSRHIFMASPENVILSPPINPPIKTFMLPKQDIVGLDLENLYAVTKTDGIPITIRVTSKGLYXYFTHLGYIIRYPVKRIIDSEVVVFGEAVKDKNWTVYLIKLIEPVNAISDRLEESKYVESKLVDIXDRIVFKSKKYEGPFTTTSEVVDMLSTYLPKQPEGVILFYSKGPKSNIDFKIKKENTIDQTANVVFRYMSSEPIIFGESSIFIEYKKFTNDKGFPKEYGSGKIVLYNGVNYLNNIYXLEYINTHNEVGIKSVVVPIKFIAEFLVNGEILKPRIDKTMKYINSEDYYGNQHNVIVEHLRDQSIKIGDVFNEDKLSDVGHQYANNDKFRLNPEVSYFTNKRTRGPLGILSNYVKTLLISMYXSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRILVYNPSTMSTPMTEYIIKKNDIVRVFNEYGFVLVDNIDFATIIERSKKFINGASTMEDRPSTRNFFELNRGAIKXEGLDVEDLLSYYVVYVFSKRC

SEQ ID NO: 265 - protein, 844 aa, Artificial sequence
  Catalytic polypeptide variant, all Cys substituted, Terminal introduced Cys
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (341)..(341): Xaa can be any naturally occurring amino acid, preferably Ala, Ser and Val
  misc_feature (457)..(457): Xaa can be any naturally occurring amino acid, preferably Ala, Ser and Val
  misc_feature (580)..(580): Xaa can be any naturally occurring amino acid, preferably Ala, Ser and Val
  misc_feature (823)..(823): Xaa can be any naturally occurring amino acid, preferably Ala, Ser and Val
MDANIVSSSTIATYIDALAKNASELEQRSTAYEINNELELVFIKPPLITLTNVVNISTIQESFIRFTVTNKEGVKIRTKIPLSKVHGLDVKNVQLVDAIDNIVWEKKSLVTENRLHKEXLLRLSTEERHIFLDYKKYGSSIRLELVNLIQAKTKNFTIDFKLKYFLGSGAQSKSSLLHAINHPKSRPNTSLEIEFTPRDNETVPYDELIKELTTLSRHIFMASPENVILSPPINAPIKTFMLPKQDIVGLDLENLYAVTKTDGIPITIRVTSKGLYXYFTHLGYIIRYPVKRIIDSDVVVFGEAVKDKNWTVYLIKLIEPNAIGDRLEESKYVESKLVDIXDRIVFKSKKYEGPFTTTSEVVDMLSTYLPKQPEGVILFYSKGPKSNIDFKIKKENTIDQTTNVVFRYMSSEPIIFGESSIFIEYKKFTNDKGFPKEYGSGKIVLYNGVNYLNNIYXLEYINTHNEVGIKSVVVPIKFIAEFLVNGEILKPRIDKTMKYINSEDYYGNQHNIIVEHLRDQSIKIGDVFNEDKLSDVGHQYANNDKFRLNPEVSYFTNKRTRGPLGILSNYVKTLLISMYXSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRILVYNPSTMSTPMTEYIIKKNDIVRVFNEYGFVLVDNIDFATIIERSKKFINGASTMEDRPSTRNFFELNRGAIKXEGLDVEDLLSYYVVYVFSKRC

SEQ ID NO: 266 - protein, 845 aa, Artificial sequence
  Catalytic polypeptide variant, all Cys substituted, Terminal introduced Cys
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (342)..(342): Xaa can be any naturally occurring amino acid, preferably Ala, Ser and Val
  misc_feature (458)..(458): Xaa can be any naturally occurring amino acid, preferably Ala, Ser and Val
  misc_feature (581)..(581): Xaa can be any naturally occurring amino acid, preferably Ala, Ser and Val
  misc_feature (824)..(824): Xaa can be any naturally occurring amino acid, preferably Ala, Ser and Val
MDANVVSSSTIATYIDALAKNASELEQGSTAYEINNELELVFIKPPLITLTNVVNISTIQESFIRFTVTNKEGVKIRTKIPLSKVHGLDVKNVQLVDAIDNIVWEKKSLVTENRLHKAXLLRLSTEERHIFLDYKKYGSSIRLELVNLIQAKTKNFTIDFKLKYFLGSGAQSKSSLLHAINHPKSRPNTSLEIEFTPRDNETVPYDELIKELTTFSRHIFMASPENVILSPPINAPIKTFMLPKQDIVGMDLENLYAVTKTDGIPITIRVTSKGLYXYFTHLGYIIRYPVKRIIDSEVVVFGEAVKDKNWTVYLIKLIEPVNAISDRLEESKYVESKLVDIXDRIVFKSKKYEGPFTTTSEVVDMLSTYLPKQPEGVILFYSKGPKSNIDFKIKKENTIDQTVNVVFRYMSSEPIIFGESSIFIEYKKFTNDKGFPKEYGSGKIVLYNGVNYLNNIYXLEYINTHNEVGIKSVVVPIKFIAEFLVNGEILKPRIDKTMKYINSEDYYGNQHNVIVEHLRDQSIKIGDVFNEDKLSDVGHQYANNDKFRLNPEVSYFTNKRTRGPLGILSNYVKTLLISMYXSKTFLDDSNKRKVLAIDFENGADLEKYFYGEIALLVATDPDADAIARGNERYNKLNSGIKTKYYKFDYIQETIRSNTFVSSVREVFYFGKFNIIDWQFAIHYSFHPRHYATIMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTRNFFELNRGAIKXEGLDVEDLLSYYVVYVFSKRC

SEQ ID NO: 267 - protein, 843 aa, Artificial sequence
  Catalytic polypeptide variant, all Cys substituted, Terminal introduced Cys
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (340)..(340): Xaa can be any naturally occurring amino acid, preferably Ala, Ser and Val
  misc_feature (456)..(456): Xaa can be any naturally occurring amino acid, preferably Ala, Ser and Val
  misc_feature (579)..(579): Xaa can be any naturally occurring amino acid, preferably Ala, Ser and Val
  misc_feature (822)..(822): Xaa can be any naturally occurring amino acid, preferably Ala, Ser and Val
MDAKVATSSTIATYIESLAKKSSELDNHSTAYEINNELELVFIKPPLIALTNVVSISTIQESFIRFTVTNREGVKIRTKIPLSKVHGLDVKNVQLVEAIDNIVWEKKTLVTETRLHKEXLLRLSTEERHIFLDYKKYGSSIRLELVNLIQAKTKNFTIDFKLKYFLGSGAQSKSSLLHAINHPKSRPNTSLEIEFTPREDEKVPYDELIKELTTVTRHIFMASPENVILSPPISSPIKTFMLPKQDIVGLDLENLYAVTKTDGVPVTIRITSKGLYXYFTHLGYIIKYPVKRAIDTDVVVFGEAIKDKNWTVYLIKLIEPVIDDRLEESNYVDSKLVGIXDRVVFKSKKYEGPFTTSSEVVDMLSTYLPKQPEGVILFYSKGSKSNVDFKIKNENTVDQAVNIVFRYMSSEPIIFGESSIFVEYKRFSNDKGFPKEYGSGKIILYNGVDYLNNIYXLTFANTHDDVGIKSIVVPIKFIAEFQVNGEILKPRIDKTMKYINSEDYYGNQHNVVVEHLRDQSIKIGNVFNEDKLSDIGHQYANNDKFRLNPEVSYFTNKRTRGPLGILSNYVKTLLISMYXSKTFLDDSNKRKVLAIDFGNGADLEKYFYGEIALLVATDPDADAIARGNERYNKLNSGIKTKYYKFDYIQETIRSETFVSSVREVFYFGKFNIIDWQFAIHYSFHPRHYATVMNNLSELTASGGKVLITTMDGDKLSKLTDKKTFIIHKNLPSSENYMSVEKIADDRILVYNPSTMSTPMTEYIIKKNDIVRVFNEYGFVLVDNVDFATIIERSKKFINGASKMEDRPSTRNFFELNRGAIKXEGLDVDDLLSYYVVYVFSKRC

SEQ ID NO: 268 - protein, 840 aa, Artificial sequence
  Catalytic polypeptide variant, all Cys substituted, Terminal introduced Cys
  misc_feature (173)..(173): Xaa can be any naturally occurring amino acid, preferably Ala, Ser and Val
  misc_feature (276)..(276): Xaa can be any naturally occurring amino acid, preferably Ala, Ser and Val
  misc_feature (340)..(340): Xaa can be any naturally occurring amino acid, preferably Ala, Ser and Val
  misc_feature (454)..(454): Xaa can be any naturally occurring amino acid, preferably Ala, Ser and Val
  misc_feature (576)..(576): Xaa can be any naturally occurring amino acid, preferably Ala, Ser and Val
  misc_feature (819)..(819): Xaa can be any naturally occurring amino acid, preferably Ala, Ser and Val
MDDKLLTSSIARYIEDLAKHSTELKNQSATYDVNNELELIFTNPPLITLTNVFNISTLQESFIRFTVTNKDGVKIRTKIPLSKVHGLDIKNSQLVDVIENIVWEKKTLINEIVYNKEVILRLSTEEKYIFLDYKKYGSSIKLELVNLIQSRTKNFIIDFKIKYFLGSGAQSKXSLLHSINHPKSKPNMSLEIEFISMDNKNVQYDKLLNELTTISRNIFMASPENVYLSPIIKIPVNTFMLHKQDIPALELENLYAVSKTDGIPVTVKLKSTGIYXYFGHIGYIIRYPIKKNLDTDIILFGEAIKDKNQWIIYLIKLLEPVIHDRLDERNYIESRLDDVXDRIIFKVKKYEGPFTTSSEIIDMLSNYLPKQNEGVILFYSKGNKNDYKIKKENTVDQMVNIVFRYMSSEPIIFGDNSIFIEYKKFSSDKGFPKENGSGKIIIYSDVNYLNNIYXIEFKNIYLDAGLKSVVVPIKFIAEFSTNGDIIKPRIGKTMRYINEEYYGNPYNVVVEHLRDQKISVNDIFNEDKLSEIGQQYVTNDKFRLNPEVSYFTNKRTRGPLGILSNYVKTLLISMYXSKTFLDNSNKRKVLAIDFGNGADLEKYFYGEIALLVATDPDADAISRGNDRYNKLNSGIKTKYYKFDYIKETIRSETYISSIREVFYFGKFDIIDWQFAIHYSFHPRHYSTVMRNLSELTASGGKVLITTMDGDKLSLLTSKKTFIIHKNLPDSENYMAIEKIADDRIMVYNPSTMSTPMTEYIIKKNDITRVFNEYGFVLIDNVDFATIINRSKKFINGVSKLEERPSTKNFFELNRGAIKXDGIDVDDLLSYYVVYVFSKRC

SEQ ID NO: 269 - protein, 841 aa, Artificial sequence
  Catalytic polypeptide variant, all Cys substituted, Terminal introduced Cys
  misc_feature (98)..(98): Xaa can be any naturally occurring amino acid, preferably Ala, Ser and Val
  misc_feature (119)..(119): Xaa can be any naturally occurring amino acid, preferably Ala, Ser and Val
  misc_feature (215)..(215): Xaa can be any naturally occurring amino acid, preferably Ala, Ser and Val
  misc_feature (276)..(276): Xaa can be any naturally occurring amino acid, preferably Ala, Ser and Val
  misc_feature (340)..(340): Xaa can be any naturally occurring amino acid, preferably Ala, Ser and Val
  misc_feature (456)..(456): Xaa can be any naturally occurring amino acid, preferably Ala, Ser and Val
  misc_feature (477)..(477): Xaa can be any naturally occurring amino acid, preferably Ala, Ser and Val
  misc_feature (479)..(479): Xaa can be any naturally occurring amino acid, preferably Ala, Ser and Val
  misc_feature (577)..(577): Xaa can be any naturally occurring amino acid, preferably Ala, Ser and Val
  misc_feature (625)..(625): Xaa can be any naturally occurring amino acid, preferably Ala, Ser and Val
MDDTFLTTSVYNYIYSLLDIYNDVPQPVHLDDVNHEVEMIFTNPSIVTLSNLINISSTQESYILFTLTRKDEHTKIRTKIPMSKIHGIDIKNIQLVNXIDNIIWEKKIRVKENIIDDWXIVQYSTEEKYIFLDYKKFTSSIKLELVNLIQARIKNIVIDFKIKYFLGSGAQSKSSLLHVLNHPKSKPKTSLEIEIVTRDIKIDTSVLSNEIHTIXKILFMSDTKNIYLYSRFKNPIKTHMLKKQDITSIDLENLYITTKTDGVGVLVKINKNGIYXYFQHLMYTIRYTLIKVLDNDVTIYGEAIKQNNVWNIYLIKMIQPVLVDRFNERDYVVSYLNNIXDRIVFKVKKYEGPFNTHSEIIDTLSTYLPLQNEGVILFYSKGSKSNIDYKIKHDNTTDNMINIIYRYMSSEPVIFGENSTFIEYKKFSDDKGFPKENGTGKLILSTDVKYLNNIYXIEFNNIYNDIGIKKVILPIKXIXEFSITGEFIKPRIDKTMKYLYEEYYGNQYHVVVDHIRDQRIHINDIFDENKLSDIGKDYANDKYRLNPEISYFTNKRVRGPLGILSNYIKTLLISLYXSKTFLDNSNKRKVLAIDFGNGADLEKYFFGEVALLVATDPDKDAIRRXMERYNKLNSGIKSKYYKFDYIRETIRSETYVSNIREVFFFGKFDIIDWQFAIHYSFHPKHYATIMNNLSELTASGGKILITTMDGDKLSMLTDKKTFIIHKNLPTTENYMSIEKISDEQILVYNPSSMSKPMEEYIVKKYDIVRIFSEYGFVLIDYINFDTVIDRSKHFINNVSKMEERQSTKNFFELNRVALKYDGLDIDELLKYYVVYVFSKRC

SEQ ID NO: 270 - protein, 841 aa, Artificial sequence
  Catalytic polypeptide variant, all Cys substituted, Terminal introduced Cys
  misc_feature (19)..(19): Xaa can be any naturally occurring amino acid, preferably Ala, Ser and Val
  misc_feature (119)..(119): Xaa can be any naturally occurring amino acid, preferably Ala, Ser and Val
  misc_feature (276)..(276): Xaa can be any naturally occurring amino acid, preferably Ala, Ser and Val
  misc_feature (284)..(284): Xaa can be any naturally occurring amino acid, preferably Ala, Ser and Val
  misc_feature (456)..(456): Xaa can be any naturally occurring amino acid, preferably Ala, Ser and Val
  misc_feature (577)..(577): Xaa can be any naturally occurring amino acid, preferably Ala, Ser and Val
  misc_feature (625)..(625): Xaa can be any naturally occurring amino acid, preferably Ala, Ser and Val
  misc_feature (797)..(797): Xaa can be any naturally occurring amino acid, preferably Ala, Ser and Val
MDDNNLKLSLSDYINKLIXVFKTIKYPLPTEDVNNEVELVFIRPPLITLGNVLNISSVQESFIMFTVGNKEKKEKIRTNVPLSKVHGLDIKNVQLVESVNNIIWEKKTLLSEYKVNDNXLIRHSIEEKHVFLDYKKYISSIKLELVNLIQAKIKNVKVDFKLKYFLGSGAQAKSSLLHVLNHPRSKPSPSLEFEIVNTDININENELFNELHALFRSIFMNLPENVFLVPNFKNPLKTYMLKKQDISGISLDNLYATTKTDGIGAIVKIKQNKIYXHFSHINYXIKYLANRTMENEIVIYGEALKYNGKWNIYLIKLINPNLENRIMEKDFVDEELKGISDKIIFKVKKYEGPFSSHSEIIDLLTFYLPMQKEGVILFYTEGKNSSFDYKIKNDNTTDHMVNLVYRYMSSEPVIFGESNTFVEFKKFSDEKGFPKDFGTGKIILTESVKYLNNIYXLEFSNVYDDVGIKNVVVPVKFISEFSSKGNIIKPRIDKTMKYMYSDYYGNQHNVVLDHVMDQNIKIEDIFNEEKLSNIGKIYANDKYRLNPETSYFTNKRTRGPLGILSNYVKTLLISLYXSKTFLDNPNKKKVLAVDFGNGADLEKYFYGEISLLVATDPDFKAIERXNERYTKLNSGIKSKYYKFNYIQETIRSNSYVSSVREVFFFGKFDIIDWQFAIHYSFHKKHYSTIMKNLSELTASGGKVLITTMDGDKLHDLKDKKTFIIHKSLPSSENYMSVEKINTEQVLVYNPSSMSKPMEEYIVRKTDIIRVFSEYGFELIDNVDFSTIINRSKKFINXVSKMEERQSTKNFFELNRDALKFNSLDVEELLSYYVVYVFSKRC

SEQ ID NO: 271 - protein, 844 aa, Artificial sequence
  Catalytic polypeptide variant, all Cys substituted, Terminal introduced Cys
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (341)..(341): Xaa can be any naturally occurring amino acid, preferably Ala, Ser and Val
  misc_feature (457)..(457): Xaa can be any naturally occurring amino acid, preferably Ala, Ser and Val
  misc_feature (580)..(580): Xaa can be any naturally occurring amino acid, preferably Ala, Ser and Val
  misc_feature (628)..(628): Xaa can be any naturally occurring amino acid, preferably Ala, Ser and Val
  misc_feature (800)..(800): Xaa can be any naturally occurring amino acid, preferably Ala, Ser and Val
MDDKIFDKSLNDYINELIGVYESIPKPKSLDDINHEVEIVFIQPPLITLNNVLNISSKQESYILFSLTNKEDRVKIRSYLPMSKVYGLDLKNIQLVDSIDNIIWEKKTLITEHIVDKHXMVRYSTEEKHIFLDYRKYISAIRLELVNLIQLKIKNILIDFKIKYFLGSGAQAKSSLLHVLNHPKSKPNVSLEFEIISGNDYKIDKDIIFNEISTLFRNIFMGNPKNIFMTPEQKNPIKTRMIKKQDITGLELDNLYITTKTDGVGSLIKINKNGIFXYFSHLNYSIRYNLLKPIDKQIVLYGEALKHGKMWNIFLIKLIEPILDDRIKEKDFINDELDNVXDRLEFKVKKYEGPFTTHSEIVDLLSSYLPIQSEGAILFYSKGNKSNIDYKIKNDNTTDHMANIIYRYMSSEPVIFGENQTFIEYKKFSDDKGFPKEFGNGKIVLSEKIRYLNNIYXITFNDLYKDVGLHTVTVPIKFIAEFTTNGEFIKPRLDKTMKYFYKNYYGNQYNVVLEHLHDQHIKINDIFDENKLSNLGEEYAKDKDKNRLNPETSYFTNKRTRGPLGILSNYIKTLLISLYXSKTFLDNTNKRKVLAIDFGNGADLEKYFYGEISLLVASDPDQDAINRXIERYNKLNSGIKSKYYKFDYIKETIRSEKYVSNIREVFFFGKFDIVDWQFAIHYSFHPKHYSTVMKNLAELTASGGKVLITTMDGDKLSQLTDKKTFIIHKNLPNSENYMSVEKLNDEKILVYNPSSMSKPMEEYIIRRSDIIRIFSEYGFVLIDYVHFDTVIDRSKKFINXVSKMEERQSTKNFFELNRDALKYEKIDIESLLQYYVVYVFSKRC

SEQ ID NO: 272 - protein, 836 aa, Artificial sequence
  Catalytic polypeptide variant, all Cys substituted, Terminal introduced Cys
  misc_feature (272)..(272): Xaa can be any naturally occurring amino acid, preferably Ala, Ser and Val
  misc_feature (336)..(336): Xaa can be any naturally occurring amino acid, preferably Ala, Ser and Val
  misc_feature (451)..(451): Xaa can be any naturally occurring amino acid, preferably Ala, Ser and Val
  misc_feature (572)..(572): Xaa can be any naturally occurring amino acid, preferably Ala, Ser and Val
  misc_feature (620)..(620): Xaa can be any naturally occurring amino acid, preferably Ala, Ser and Val
  misc_feature (776)..(776): Xaa can be any naturally occurring amino acid, preferably Ala, Ser and Val
MDESKKRGTDYIEELIRVYEDVPNPVQTDDINHEVELTFIHPPIIALSTLIHVATSQESYILFTVTNKGVKIRNRINLSKIHGLDLKNIQLVDSIDNIIWEKKTLVKEHKVDPAAVVKYSTEEKYIFLDYKKYLSSIKLELVNVVQAKVKHVTVDFKFKYFLGSGAQAKSSLLHVLNHPKSKPNPSLEFEIVTTDEKIDSVSLRKELVALFKLVFMTSPDNIILDGILKPPVQTVMLKKNDLPGIDLTNLYVTTKTDGVGVLITVTNKGIYXFFTHLQYTIRYDTTFKSDNPVTLYGEAIKQNNVWHVYLIKLMTPKLSDRFKEKDYVEEHLKDIXDRMIFKVKKYEGPFESHSEIIDLLTSYLPSQPEGVVLFYSDQRNQPDYKIKLDNTTDHMVNIIYRYMSSEPVIFGENSTFLEYKKFSDDKGFPKDYGTGKLALTDNVRYLNNIYXMEFANAYEDVGIKNVVVPIKFISEFSATGEFIKPRIDKTFRYLYMEYYGNPYQVVVTHIRDQSIKIGDVFDEDRLSDVGQHYANDKYRLNPDVSYFTNKRTRGPLGILSNYVKTLLISLYXSKTFLDNSNKRKVLAIDFGNGADLEKYFYGEISSLVATDPDKEAITRXIERYNSLNSGIKSKYYKFDYIQETIRSTTYVSSVREVFFFGKFDLVDWQFAIHYSFHPKHYTTVMNNLAELTASGGKVLITTMDGDLLSQLTDKKTFVIHKNLPSSENYMSVEKIHEDQILVYNPSSMSRPMQEYIIKRANLTKIFSEYGFELIDXVHFDTVVERSKRFITGVSKMEERKSTKNFFELNREALKYEGTDIGDLLRYYIVYVFSKRC

SEQ ID NO: 273 - protein, 841 aa, Artificial sequence
  Catalytic polypeptide variant, all Cys substituted, Terminal introduced Cys
  misc_feature (19)..(19): Xaa can be any naturally occurring amino acid, preferably Ala, Ser and Val
  misc_feature (119)..(119): Xaa can be any naturally occurring amino acid, preferably Ala, Ser and Val
  misc_feature (276)..(276): Xaa can be any naturally occurring amino acid, preferably Ala, Ser and Val
  misc_feature (284)..(284): Xaa can be any naturally occurring amino acid, preferably Ala, Ser and Val
  misc_feature (456)..(456): Xaa can be any naturally occurring amino acid, preferably Ala, Ser and Val
  misc_feature (486)..(486): Xaa can be any naturally occurring amino acid, preferably Ala, Ser and Val
  misc_feature (577)..(577): Xaa can be any naturally occurring amino acid, preferably Ala, Ser and Val
  misc_feature (625)..(625): Xaa can be any naturally occurring amino acid, preferably Ala, Ser and Val
  misc_feature (797)..(797): Xaa can be any naturally occurring amino acid, preferably Ala, Ser and Val
MDDDNLKLSLLDYIKKLIXVFKTIKNPLPTEDVNNEVELIFIQPPLITLGNLLNISSVQESFIMFTVGNKGKKVKIRTKVPLSKVHGLDIKNIQLVDSVDNIIWEKKTLVYEDVINDYXLIRHSTEEKHVFLDYKKYISSIKLELVNLIQTRIKHIQVDFKLKYFLGSGAQAKSSLLHVLNHPKSKPTPSLEFEIVNTDIKIDENELLNEMYTLFRSIFMNLPENVFLVPSFKNPLKTYMLKKQDIAGLHLENLYATTKTDGIGTIVKIKQNEIYXHFSHINYXIKYLANRTIENEILLYGEALKHKGKWSIYLIKLMKPKLENRIKEKDFVDENLKEISEKIIFKVKKYEGPFSSHSEIIDLLTFYLPVQKEGVILFYIEGKNSNSDYKIKNDNTTDHMINVVYRYMSSEPVIFGDSNTFIEFKKFSDEKGFPKDFGTGKIILTESIKYLNNIYXLEFSNVYEDVGIKKVVVPVKFISEFSSKGXLLKPRIDKTMKYMYSDYYGNQYNIVMDHIMDQNIKIEDIFNEEKLSDIGKNYADDKYRLNPEVSYFTNKRTRGPLGILSNYIKTLLISLYXSKTFLDNSNKKKVLAIDFGNGADLEKYFYGEISLLVATDPDSKAIERXNERYTKLNSGIKSKYYKFNYIQETIRSSSYVSSVREVFFFGKFDIIDWQFAIHYSFHKKHYSTIMKNLTELTASGGKVLITTMDGDKLYNLKDKKTFIIHKSLPSSENYMSVEKINSEQILVYNPSSMSKPMEEYIVKKLDIVRIFSEYGFELIDNVNFDTVINRSKKFINXVSKMEERQSTKNFFELNREALKFDVLDVEELLSYYVVYVFSKRC

SEQ ID NO: 274 - protein, 843 aa, Artificial sequence
  Catalytic polypeptide variant, all Cys substituted, Terminal introduced Cys
  misc_feature (73)..(73): Xaa can be any naturally occurring amino acid, preferably Ala, Ser and Val
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (458)..(458): Xaa can be any naturally occurring amino acid, preferably Ala, Ser and Val
  misc_feature (579)..(579): Xaa can be any naturally occurring amino acid, preferably Ala, Ser and Val
  misc_feature (627)..(627): Xaa can be any naturally occurring amino acid, preferably Ala, Ser and Val
  misc_feature (783)..(783): Xaa can be any naturally occurring amino acid, preferably Ala, Ser and Val
MDERDLENSLSDYIDKIVEIYDEIPNPTLSNDVNHEVELVFIQPPIITLSNVYNISSVTESYILFTVTNKEEXIKIRTKVPMSKIHGLDLKNLQLVDLIDDIIWEKKTLIKEKKIDKHXIIRYSSEERHVFLDYKRYTSSIKLELVNLVQTKVKNIVVDFKIKYFLGSGAQAKSSLLHVLNHPKSKPTPTLEFEIITREKKNSRDILLNELHILFKNIFMADPKNVFLPTVIFTSPVKTIMLKKQEIHNIELDKLYITTKTDGVGTLIKINKNGIFXYFTHLNYIIKYNLLRKFDDTVILYGEAIKQNKKWFIYLIKLLKPELSNRFKERDFLIEKLTSDISDRIVFKTKKYEGPYETHSEVIDLLSTYLPLQTEGVILFYSEGNKSKIDYKIKHDNTTDHMINAVYRYMSSEPVIFGDKYTFIEFKKFSDERGFPKEHGTSKIILGNNIKYLNNIYXIEFKNIYKDVGIKNIVLPIKFISEFSFNGNFLKPRLDKTMKYFYKEYYGNQYQVVLEHIRDQELRINDIFDENKLSDLGKKYVDDEFRLNPEVSYFTNKRTRGPLGILSNYIKTLLISLYXSKTFLDNPNKRKVLAVDFGNGADLEKYFYGEIALLVATDPDKDAISRXIERYNKLNSGIKSKYYKLDYIQETIRSSVYVSKIREVFFFGKFDIVDWNFAIHYSFHPKHYSTIMKNLSELTAPGGNVLITTMDGDKLSYLLERKVFIIHKNLPSSENYMSVEKISDDKILVYNPSSMSKPMEEYIVKKSDIKRVFSEYGFVLIDXVNFDTVINRSKKFINYVSKMEERQSTKNFFELNREALKYDNIDIEELLNYYVVYVFSKRC

SEQ ID NO: 275 - protein, 837 aa, Artificial sequence
  Catalytic polypeptide variant, all Cys substituted, Terminal introduced Cys
  misc_feature (273)..(273): Xaa can be any naturally occurring amino acid, preferably Ala, Ser and Val
  misc_feature (337)..(337): Xaa can be any naturally occurring amino acid, preferably Ala, Ser and Val
  misc_feature (452)..(452): Xaa can be any naturally occurring amino acid, preferably Ala, Ser and Val
  misc_feature (573)..(573): Xaa can be any naturally occurring amino acid, preferably Ala, Ser and Val
  misc_feature (621)..(621): Xaa can be any naturally occurring amino acid, preferably Ala, Ser and Val
  misc_feature (777)..(777): Xaa can be any naturally occurring amino acid, preferably Ala, Ser and Val
MDDSKKKRGTDYIEELILLYEDVPNPVQTDDMNHEVELTFIQPPVITLSTLLPFATSQESYILFTVTNKGVKIRNRINLSKIHGLDLKNIQLVDSIDNIIWEKKTLVKEHKIDSVALVKYSTEEKYIFLDYKKYLSAIKLELVNVVQVKVKHVTVDFKFKYFLGSGAQAKSSLLHVLNHPKSKPNPSLEFEIITTDEKIDSASLRKELIALFKLVFMASPSNIILDVVFKNPVQTILLKKNELPGIDLTNLYVTTKTDGVGVLITVTNKGIYXFFTHLQYTIRYDTTFESNESVTLYGEAVKQNNVWQIYLIKLITPKVSDRFKEKEYVEERLQNIXDRMTFKVKKYEGPFESHSEIIDLLTTYLPSQPEGVVLFYSDQRNQPDYKIKLDNTTDHMINIIYRYMSSEPVIFGENSTFLEYKKFSDDKGFPKDYGTGKLMLTDNVRYLNNIYXIAFTNVYEDVGIKNVVVPIKFISEFSATGELIKPRIDKTFKYLYKEYYGNQYQIVVAHIRDQNIKIGDVLDEDKLSDVGQHYANDKYRLNPDVSYFTNKRTRGPLGILSNYVKTLLISLYXSKTFLDNSNKRKVLAIDFGNGADLEKYFYGEISSLVATDPDKEAIGRXIERYNSLNSGIKSKYYKFDYIQETIRSVTYVSSVREVFFFGKFDLVDWQFAIHYSFHPKHYATVMNNLTELTASGGKVLITTMDGDLLSQLTDKKTFVIHKNLPSSENYMSVEKIHEDQILVYNPSSMSRPMQEYIVKRVNLTKIFSEYGFELIDXVHFDTIIERSKRFINSVSKMEERKSTKNFFELNREALKHEGTDIDDLLRYYIVYVFSKRC

SEQ ID NO: 276 - protein, 843 aa, Artificial sequence
  Catalytic polypeptide variant, all Cys substituted, Terminal introduced Cys
  misc_feature (73)..(73): Xaa can be any naturally occurring amino acid, preferably Ala, Ser and Val
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (458)..(458): Xaa can be any naturally occurring amino acid, preferably Ala, Ser and Val
  misc_feature (579)..(579): Xaa can be any naturally occurring amino acid, preferably Ala, Ser and Val
  misc_feature (627)..(627): Xaa can be any naturally occurring amino acid, preferably Ala, Ser and Val
  misc_feature (783)..(783): Xaa can be any naturally occurring amino acid, preferably Ala, Ser and Val
MDERDLENSLSDYINKIVEIYDEIPNPTLSNDVNHEVELVFIQPPIITLSNVYNISSVTESYILFTVTNKGEXIKIRTKVPMSKIHGLDLKNLQLVDLIDDIIWEKKTLIKEKKIDKHXIIRYSSEERHVFLDYKRYTSSIKLELVNLVQTKVKNIVVDFKIKYFLGSGAQAKSSLLHVLNHPKSKPTPTLEFEIITREKKNSRDILLDELHILFKNIFMADPKNVFLPTVIFTSPVKTIMLKKQEIHNIELDKLYITTKTDGVGTLIKINKNGIFXYFTHLNYIIKYNLLRKFDDTVILYGEAIKQNQKWFIYLIKLLKPELSNRFKERDFLIEKLTSDISDRIVFKTKKYEGPYETHSEVIDLLSTYLPLQTEGVILFYSEGNKSKIDYKIKHDNTTDHMINAVYRYMSSEPVIFGDKYTFIEFKKFSDERGFPKEHGTSKIILGDNIKYLNNIYXIEFKNIYNDVGLKNIVLPIKFISEFSFNGDFLKPRLDKTMKYFYKEYYGNQYQVVLEHIRDQELRINDIFDENKLSDLGKKYVDDEFRLNPEVSYFTNKRTRGPLGILSNYIKTLLISLYXSKTFLDNPNKRKVLAVDFGNGADLEKYFYGEIALLVATDPDKDAISRXIERYNKLNSGIKSKYYKLDYIRETIRSSVYVSKIREVFFFGKFDIVDWNFAIHYSFHPKHYSTIMKNLSELTAPGGNVLITTMDGDKLSYLSERKVFIIHKNLPSSENYMSVEKISDDKILVYNPSSMSKPMEEYIVKKSDIKRVFSEYGFVLIDXVNFDTVINRSKKFINYVSKMEERQSTKNFFELNREALKYDNIDIEELLNYYVVYVFSKRC

SEQ ID NO: 277 - protein, 843 aa, Artificial sequence
  Catalytic polypeptide variant, all Cys substituted, Terminal introduced Cys
  misc_feature (73)..(73): Xaa can be any naturally occurring amino acid, preferably Ala, Ser and Val
  misc_feature (119)..(119): Xaa can be any naturally occurring amino acid, preferably Ala, Ser and Val
  misc_feature (277)..(277): Xaa can be any naturally occurring amino acid, preferably Ala, Ser and Val
  misc_feature (458)..(458): Xaa can be any naturally occurring amino acid, preferably Ala, Ser and Val
  misc_feature (579)..(579): Xaa can be any naturally occurring amino acid, preferably Ala, Ser and Val
  misc_feature (627)..(627): Xaa can be any naturally occurring amino acid, preferably Ala, Ser and Val
  misc_feature (783)..(783): Xaa can be any naturally occurring amino acid, preferably Ala, Ser and Val
MDERNLENSLSDYINKIVEIYDEIPNPILSNDVNHEVELVFIQPPIITLSNVYNISSVTESYILFTVTNKGEXIKIRTKVPMSKIHGLDLKNLQLVDLIDDIIWEKKTLIKEKKIDKHXIIRYSSEERHVFLDYKRYTSSIKLELVNLVQTKVKNIVVDFKIKYFLGSGAQAKSSLLHVLNHPKSKPTPTLEFEIITREKKNSSDMLLNELHILFKNIFMADPKNVFLPTVIFTSPVKTIMLKKQEIHNIELDKLYITTKTDGVGTLIKINKNGIFXYFTHLNYIIKYNLSRKFDDTVILYGEAIKQNQKWFIYLIKLLKPELSNRFKERDFLIEKLTSDISDRIVFKTKKYEGPYATHSEVIDLLSTYLPLQTEGVILFYSEGNKSKIDYKIKHDNTTDHMINAVYRYMSSEPVIFGDKYTFIEFKKFSDERGFPKENGTSKIILGNNIKYLNNIYXIEFKNIYKDVGLKNIVLPIKFISEFSFNGNFLKPRLDKTMKYFYKEYYGNQYQVVLEHIRDQELRINDIFDENKLSDLGKKYVDDEFRLNPEVSYFTNKRTRGPLGILSNYIKTLLISLYXSKTFLDNPNKRKVLAVDFGNGADLEKYFYGEIALLVATDPDKDAISRXIERYNKLNSGIKSKYYKLDYIRETIRSSVYVSKIREVFFFGKFDIVDWNFAIHYSFHPKHYSTIMKNLSELTAPGGNVLITTMDGDKLSYLSERKVFIIHKNLPSSENYMSVEKISDDKILVYNPSSMSKPMEEYIVKKSDIKRVFSEYGFVLIDXVNFDTVINRSKKFINYVSKMEERQSTKNFFELNREALKYDNIDIEELLNYYVVYVFSKRC

SEQ ID NO: 278 - protein, 842 aa, Artificial sequence
  Catalytic polypeptide variant, all Cys substituted, Terminal introduced Cys
  misc_feature (118)..(118): Xaa can be any naturally occurring amino acid, preferably Ala, Ser and Val
  misc_feature (275)..(275): Xaa can be any naturally occurring amino acid, preferably Ala, Ser and Val
  misc_feature (341)..(341): Xaa can be any naturally occurring amino acid, preferably Ala, Ser and Val
  misc_feature (455)..(455): Xaa can be any naturally occurring amino acid, preferably Ala, Ser and Val
  misc_feature (577)..(577): Xaa can be any naturally occurring amino acid, preferably Ala, Ser and Val
  misc_feature (626)..(626): Xaa can be any naturally occurring amino acid, preferably Ala, Ser and Val
  misc_feature (701)..(701): Xaa can be any naturally occurring amino acid, preferably Ala, Ser and Val
MDATPEHPLSEFLGELARAAAEVAAEPAAVDVHHELELVFIRPPLAALGAIVGLATEQTSYVLFTVSSRDGVKLRVKLPMSRVHGLDAKNVQLVDAVDDIIWEKKTLVSQRELAGGAXLLRHSTEERHIFVDFKKFGSSIKLELVNLIRISARNIVTDFKFKYFLGSGTQAKSSLLHALNHPKSRPNATLEFEVLRRDADATAEQLAEELTTVARAIFMAHPDNVFLVPPVRDPIRTHMLKKQNILSLELQGLYATSKTDGVAATVRVDASGVYXFFNHLGYVIRYPALREVEEPVVLFGEAVRSAEDRRWHVHLIKLVAPTLESRLEEHEFVERRMEGLXDRVVFRAKRFMGPFASVSELTDMLTEELPKQEEGVVLFYASGEAPDMKIKKDNTVDQAVNVTFRYMSSEPVIFGDKATFVEYKRFSDERGFPREHGSGRIVIGDSVAYLNNVYXLSFAGTHDTVGLSRVVLPVKFVAEFSHDGTLLRPRVDKTMRYLYSSGYYGNQHSVVVDHLRDQALSVGDVFVGEKLAEAGRNLANDEFRLNPDTSYFVKNRTRGPLGILSNYVKTLLISLYXSKTFLDNANRRKVLAIDFGNGADLEKYFYGEVALLVATDPDARAIERGXERYNRLNSGIKSRYYKFDYVQETIRSDTFVSSIRKVFYFGRFDIVDWQFAIHYSFHPRHYATVMRNLSELTASGXKVLITTMDGDFLSSITSTRSFVINRALQESENFISFERIDDEQVLVYNPSTMAKPMAEYIVKKEALVRVFGEYGFVLIDHVDFATVVRRGRAFVEGVARMETRQSTRNFFDLNRVALADMRDTDVEELLQYYVVYVFSKRC

SEQ ID NO: 279 - protein, 855 aa, Artificial sequence
  Catalytic polypeptide variant, all Cys substituted, Terminal introduced Cys
  misc_feature (132)..(132): Xaa can be any naturally occurring amino acid, preferably Ala, Ser and Val
  misc_feature (198)..(198): Xaa can be any naturally occurring amino acid, preferably Ala, Ser and Val
  misc_feature (289)..(289): Xaa can be any naturally occurring amino acid, preferably Ala, Ser and Val
  misc_feature (451)..(451): Xaa can be any naturally occurring amino acid, preferably Ala, Ser and Val
  misc_feature (470)..(470): Xaa can be any naturally occurring amino acid, preferably Ala, Ser and Val
  misc_feature (515)..(515): Xaa can be any naturally occurring amino acid, preferably Ala, Ser and Val
  misc_feature (591)..(591): Xaa can be any naturally occurring amino acid, preferably Ala, Ser and Val
  misc_feature (639)..(639): Xaa can be any naturally occurring amino acid, preferably Ala, Ser and Val
  misc_feature (795)..(795): Xaa can be any naturally occurring amino acid, preferably Ala, Ser and Val
MEKKHYLFNKYIMEEDNIFDTSVYKYINELIKVYKNIKPHSPTDDIYDEVEAVIINPPLITLTNVFNISTKIESYMLFTVTNKEDGFKIRSRLNMSNIYGLDIKNVQLIDSIDNIIWEKKKLITEEKVDENXIIRHSTEEKHIFLDFKKYNSSIKIEFVNLIQSKIKNILVDFKLKYFLGSGAQGKSSLLHVLNYPKXKPNMSLEFEILHKDKPINETDLYNELVTIYRNIFMGYPKNIFLKRQLSYPIHTYMLKKQDISGISLDDLYITNKTDGVGTYITILDSGIYXYFSHLNYTIRYDINKKINTTTVKLYGEGLKYDGKWSIYLIKLITPSFDDRFKEKEFVSNELLNISDKIQIKTKKYYGPFTTHSELIDTIIEYLPNQQEGLVLFYKTGENSNKDYKIKNDNTTDHMINAIYRYMSSEPVIFGEDNTFVEYKKFSDEKGFPKEXGTGKLILSDNVKYLNNIYXIEFYNIYNTVGLNNVVLPIKFISEFSSNGNFLRPRIDKTAKYIKXDYFGNQYNVVLEHIMDQQLKITDIFDDNKLSDIGQKYNIEKNRLNPDISYFTNKRTRGPLGILSNYIKTLLISLYXSKTFLDNSNKRKVLAVDFGNGADLQKYFYGEISLLVASDPDKDAINRXIERYNKLNSGIKSKYYKFDYINDTIRSESYISNIRKVFFFGKFDIIDWQFAIHYSFHKKYYSVVMNNLSELTASGGKVLITTMDGDKLSEITGIKKFIINKKLPESENYMSIEKISNETILVYNPSSMSKPMEEYIIKYKDISRIFLEYGFELIDXVHFNTIIDRSNRFINNVSKMEQRESTKNFFDLNREVLNDNIDDINELLEYYIVYVFSKRC

SEQ ID NO: 280 - protein, 951 aa, Artificial sequence
  Catalytic polypeptide variant, all Cys substituted, Terminal introduced Cys
  misc_feature (223)..(223): Xaa can be any naturally occurring amino acid, preferably Ala, Ser and Val
  misc_feature (381)..(381): Xaa can be any naturally occurring amino acid, preferably Ala, Ser and Val
  misc_feature (447)..(447): Xaa can be any naturally occurring amino acid, preferably Ala, Ser and Val
  misc_feature (563)..(563): Xaa can be any naturally occurring amino acid, preferably Ala, Ser and Val
  misc_feature (686)..(686): Xaa can be any naturally occurring amino acid, preferably Ala, Ser and Val
  misc_feature (733)..(733): Xaa can be any naturally occurring amino acid, preferably Ala, Ser and Val
  misc_feature (810)..(810): Xaa can be any naturally occurring amino acid, preferably Ala, Ser and Val
  misc_feature (930)..(930): Xaa can be any naturally occurring amino acid, preferably Ala, Ser and Val
MDEHLERPLEYYFRELVAEFERAVRRGDSAVKKNSPKRSRAPQSLTNSKGNAGGKAEPEPELENGNTGAGAPKARTRAAPEAQAAHPPVSAHKSRPRAHAAFTSRARTEEREPGPALEPVHGPAPAPAADTTSDVHHEVELIFVRPPLVTLSHLLGIATRQESYVLFSLTSLEREGVKLRTRLPLARVHGLDMKNNQLVEAIDSILWEKKTRVAQRDFPEAHXLLRHSTEEQYVFLDFRNFNSAIRLELVNHVQARVRNIVVDFKLKYFLGSGAQTRNSLLAVLNYPKFRPSVTLEFEVLLRDPAAFSPRELLRELLVLGNLLFMAPAEHVFLMPAPKEPLTTHMLKKQDLLTLELRDLYVTGKTDGVPTFVHVAGASVYXFFSHLGYAIRYPARVTLPAPVALFGEAVRDAQSKQLTVYLIKLMAPALEDRLEEREFVLRRLQGLXERVAFQAKQYEGPFATSSELTDALAQMLAAQPEGVVLFYARGSRSGADLKLKRDNTVDQAVNVIYRYMSSEPVIFGDGVTFLEFKRFSNDKGFPKEFGTGRLVLAEGARYLNNIYXLEFADTHSGVGLRKVVVPVKFVGEFSHDGRLLRPRLAKTMLYLSNANYYGNQASVVLEHLQDQRLRVGDVFREDKLADAGKAAAVADAHRLNPDTAYFTKRRVRGPLGVLSNYVKTLLISLYXSKTFFDNPNKRKVLAVDFGNGADLEKYFYGEIALLIATDPDARAIEXGRERYNKLNSGNKSKYYKFDYIQETIRSESFVASVREVFYFGKFDIVDWQFAIHYSFHPRHYATVMRNLAELTASGXRVLITTVDGDFLATLTRKRSFVIHRDLPEPENYISFEKLDSEHVLVYNPSTMAKPMVEYIVRKQALVRVFGEYGFVLVDHVDFHTVVHRSRAFIDGVAQMESRTSTKNFFELNRAALQSXRGLDVEELLQYYVVYVFAKRC

SEQ ID NO: 281 - protein, 850 aa, Artificial sequence
  Catalytic polypeptide variant, all Cys substituted, Terminal introduced Cys
  misc_feature (124)..(124): Xaa can be any naturally occurring amino acid, preferably Ala, Ser and Val
  misc_feature (281)..(281): Xaa can be any naturally occurring amino acid, preferably Ala, Ser and Val
  misc_feature (306)..(306): Xaa can be any naturally occurring amino acid, preferably Ala, Ser and Val
  misc_feature (347)..(347): Xaa can be any naturally occurring amino acid, preferably Ala, Ser and Val
  misc_feature (463)..(463): Xaa can be any naturally occurring amino acid, preferably Ala, Ser and Val
  misc_feature (585)..(585): Xaa can be any naturally occurring amino acid, preferably Ala, Ser and Val
  misc_feature (709)..(709): Xaa can be any naturally occurring amino acid, preferably Ala, Ser and Val
  misc_feature (840)..(840): Xaa can be any naturally occurring amino acid, preferably Ala, Ser and Val
MSSPDTGPVPGPSLDEMLVALAAKAASVDRGPAEDEVHHEVELVLVNPPLSTLAVALRLASETESFILFTVTALAKEEGKLRARMPLSRVVGLDVKNVQLVNAIDSIVWERKALVEETELRAEXLLRHSTERRHLFVDFKKYMSAIRVELVNRVRVRSREVQADFKFKYFLGSGAQSKSSLLHALNHPKMRPSPTLEFEVVPSEAAVDEAAVLAELRAMAKALFMAPAEAVFLEPPPRMPVKTHMLPKQEIPSLDLQGLYAVSKTDGVPAAVTVDESGVYXAFAHLGYTIRYAAARAPAKQYRLRXEAVRHVGERVWSMYIILVEEPAGVDRVAAAEAAAEELRGVXARVEFKAKRVEGPFYSTSELVDFLAGALKAEPEGVVLFYASGERAARDFKVKRDNSVDQTANVVFRYMSSEPIVFGEGSTFLEFKRYSNDNGFPKEYGSGRIFLREDVIYHNNIYXVEFARTHADVGLRSVVVPVKFVGEFSSEGALLRPRLDKTALYFRNASYYGNQHSVVLEHARDQLLAVGDVLDESRMAAVGHTLANDAFRLNPDTPYFTNRRTRGPLGVLSNYVKTLMISLYXSKTFLNNPERRKVLAVDFGNGADLEKYFFGEIVSMVATDPDARAIERAMERYNRLNAGIKSRYYKFNYIQETIRSDTYVESIRQVMYFGRFNIVDWQMAIHYSFHPRHFATVMRNLRELTAPGXKVLVTTMDGDYLSTLAGKVSFVINKNLQESENFMSLERVAEDQVLVYTPSTMAQPMAEYIVRRADIVRLFADSGFDLVDHADFETVIRRSRRFVEGVSRLETRPSTKNFFELNRTALAEMEGTDVAALLKXYVLYVFSKRC

SEQ ID NO: 282 - protein, 843 aa, Artificial sequence
  Catalytic polypeptide variant, all Cys substituted, Terminal introduced Cys
  misc_feature (116)..(116): Xaa can be any naturally occurring amino acid, preferably Ala, Ser and Val
  misc_feature (274)..(274): Xaa can be any naturally occurring amino acid, preferably Ala, Ser and Val
  misc_feature (293)..(293): Xaa can be any naturally occurring amino acid, preferably Ala, Ser and Val
  misc_feature (299)..(299): Xaa can be any naturally occurring amino acid, preferably Ala, Ser and Val
  misc_feature (337)..(337): Xaa can be any naturally occurring amino acid, preferably Ala, Ser and Val
  misc_feature (340)..(340): Xaa can be any naturally occurring amino acid, preferably Ala, Ser and Val
  misc_feature (456)..(456): Xaa can be any naturally occurring amino acid, preferably Ala, Ser and Val
  misc_feature (578)..(578): Xaa can be any naturally occurring amino acid, preferably Ala, Ser and Val
  misc_feature (702)..(702): Xaa can be any naturally occurring amino acid, preferably Ala, Ser and Val
MSAPSLDELLVALAAKAAAVDRGSPADEVHHEVELVLVHPPLATLATALRLASETESFILFTVTALAKEEGKLRARMPLSRVVGLDVKNVQLVNSIDTIVWERKSLVEETELHPGXLLRHSTERRHLFVDFKKYLSAIRVELVNLVRVRSKEVIADFKFKYFLGSGAQAKSALLHALNHPKIRPSATLEFEVVPSGETLDEASVLAELRAMAKALFMAGSDSVFLTPALSAPPVRTVMLQKQEIPALELEGLYSVSKTDGVLAAVAVTEDGVRXSFGHLGYTIRYPLAKAPKXEYRLWXEAVRPVGERVWAMHVLFVEEPQGSDRIADAAAAAEALXGVXARVEFKSKRVDGPFSATSELVEHISSAIKTEPEGIVLFYASGERSKLDFKVKRDNTVDQTTNVTFRYMSSEPIVFGDGATFLEFKRFSNDKGFPKDYGTGRIFLRDDVIYHNNIYXIEFTKTHREVGLASVVVPVKFISEFSQEGYLLRPRPEKTMKYLRNPSYYGNQHSVVLEHARDQLLSVMDVFDENRMAAVGHTLANDAFRLNPDTPYFTNRRTRGPLGVLSNYVKTLMISLYXSKTFLNNPEKRKVLAVDFGNGADLEKYFFGEIASMVATDPDARAIERAMDRYNRLNAGLKSRYYKFNYIQETIRSETYVESIRQVMYFGRFNLVDWQMAIHYSFHARHFATVMRNLRELTAPGXKVLITTMDGDYLATLTGKVSFVINRNLQESENFMSVERVAEDQVMVYTPSTMAQPMTEYIVRREDIVKLFADNGFDLIDHANFETVIRRSRRFVEGVSRLETRPSTKNFFELNRNALEEMDRTDVAELLKRYVLYVFSKRC

SEQ ID NO: 283 - protein, 842 aa, Artificial sequence
  Catalytic polypeptide variant, all Cys substituted, Terminal introduced Cys
  misc_feature (8)..(8): Xaa can be any naturally occurring amino acid, preferably Ala, Ser and Val
  misc_feature (116)..(116): Xaa can be any naturally occurring amino acid, preferably Ala, Ser and Val
  misc_feature (273)..(273): Xaa can be any naturally occurring amino acid, preferably Ala, Ser and Val
  misc_feature (298)..(298): Xaa can be any naturally occurring amino acid, preferably Ala, Ser and Val
  misc_feature (339)..(339): Xaa can be any naturally occurring amino acid, preferably Ala, Ser and Val
  misc_feature (455)..(455): Xaa can be any naturally occurring amino acid, preferably Ala, Ser and Val
  misc_feature (496)..(496): Xaa can be any naturally occurring amino acid, preferably Ala, Ser and Val
  misc_feature (577)..(577): Xaa can be any naturally occurring amino acid, preferably Ala, Ser and Val
  misc_feature (701)..(701): Xaa can be any naturally occurring amino acid, preferably Ala, Ser and Val
MDAPSLDXMLAALAAKAASVDRGAPEDEVHHEVELVLVDPPLSTLAATLRLASETESFILFTVTALAKEEGKLRARVPMSRVVGLDVKNVQLVNAIDSIVWERKALVEETALQEGXLLRHSTERRHLFVDYKKYLSAIRVELVNRVRVRSKEVVVDFKFKYFLGSGAQAKSSLLHALNHPKVRPSPTLEFEVVPAGEAVDEAAVLTELRAVAKALFMAPTDAVFLLPPAEMPVRTLMLQKQEIPALDLDGLFAVSKTDGVSASVRVDENGVFXAFSHLAYTIRYPLAREVQGRYRLWXEAVRPVGERVWSMFVLVVEEPAGDDRVAAVAGAVEALRGVXARVEFKPKRVDGPFSATSELVEHIKSALQTEPEGVVLFYARGEKSKRDLKVKRDNTVDQTTNVMFRYMSSEPIVFGEGSTFLEFKRYSNDRGFPKEYGAGRIFLREDVVYHNNIYXIEFTKTHLEVGLRSVVVPVKFIGEFSQEGYLLRPRLAKTEXYFRNPSFYGNQHSVVLEHTRDQLLSVGDVFDESRMAAVGQTLANDAFRLNPDTPYFTNRRTRGPLGVLSNYVKTLMISLYXSKTFLNNAERRKVLAVDFGNGADLEKYFFGEIASMVATDPDARAIERAMERYNRLNAGLKSRYYKFNYIQETIRSETYVESIRQVMYFGRFNIVDWQMAIHYSFHPRHFATVMRNLRELTAPGXKVLITTMDGDFLSTLSEKTSFVINRNLQESENFMSIERVADDQVMVYAPSTMAQPMTEYIVRRADIVKLFADNGFDLVDHANFETVIRRSRRFVEGVSRLETRPSTKNFFELNRNALTEMDSTDVAALLKIYVLYVFSKRC

SEQ ID NO: 284 - protein, 842 aa, Artificial sequence
  Catalytic polypeptide variant, all Cys substituted, Terminal introduced Cys
  misc_feature (8)..(8): Xaa can be any naturally occurring amino acid, preferably Ala, Ser and Val
  misc_feature (116)..(116): Xaa can be any naturally occurring amino acid, preferably Ala, Ser and Val
  misc_feature (273)..(273): Xaa can be any naturally occurring amino acid, preferably Ala, Ser and Val
  misc_feature (298)..(298): Xaa can be any naturally occurring amino acid, preferably Ala, Ser and Val
  misc_feature (339)..(339): Xaa can be any naturally occurring amino acid, preferably Ala, Ser and Val
  misc_feature (455)..(455): Xaa can be any naturally occurring amino acid, preferably Ala, Ser and Val
  misc_feature (577)..(577): Xaa can be any naturally occurring amino acid, preferably Ala, Ser and Val
  misc_feature (701)..(701): Xaa can be any naturally occurring amino acid, preferably Ala, Ser and Val
MDAPSLDXMLAALAAKAAAVDRGAPEDEVHHEVELVLVNPPLSTLAATLRLASETESFILFTVTALAKEEGKLRARVPMSRVVGLDVKNVQLVNAIDSIVWERKALVEETALQEGXLLRHSTERRHLFVDYKKYLSAIRVELVNRVRVRSKEVVADFKFKYFLGSGAQAKSSLLHALNHPKVRPAATLEFEVVPAGEAVDEAAVLAELRAVAKALFMAPTDAVFLTPPADMPVRTLMLQKQEIPALELEGLFAVSKTDGVSASVRVDAGGVFXAFSHLGYTIRYPLAREVKGVFRLWXEAVRPVGERVWSLFVLFVEEPAGEDRVAAVAAAVEALRGVXARVEFKPKRVDGPFSATSELVEHIKGALQTEPEGVVLFYASGEKAKRDLKVKRDNTVDQTTNVMFRYMSSEPIVFGEGSTFLEFKRYSNDRGFPKEYGAGRIFLREDVVYHNNIYXIEFTKTHLEVGLRSVVVPVKFIGEFSQEGYLLRPRLAKTELYFRNPSFYGNQHSVVLEHTRDQLLSVGDVFDESRMAAVGQTLANDAFRLNPDTPYFTSRRTRGPLGVLSNYVKTLMISLYXSKTFLNNAERRKVLAVDFGNGADLEKYFFGEIASMVATDPDARAIERAMERYNRLNAGLKSRYYKFNYIQETIRSETYVESIRQVMYFGRFNIVDWQMAIHYSFHPRHFATVMRNLRELTAPGXKVLITTMDGDFLSTLTEKTSFVINRNLQESENFMSLERVAEDQVMVYAPSTMAQPMTEYIVRRADIVKLFADNGFDLVDHANFETVIRRSRRFVEGVSRLETRPSTKNFFELNRNALAEMDSTDVTALLKIYVLYVFSKRC

SEQ ID NO: 285 - protein, 849 aa, Artificial sequence
  Catalytic polypeptide variant, all Cys substituted, Terminal introduced Cys
  misc_feature (123)..(123): Xaa can be any naturally occurring amino acid, preferably Ala, Ser and Val
  misc_feature (184)..(184): Xaa can be any naturally occurring amino acid, preferably Ala, Ser and Val
  misc_feature (218)..(218): Xaa can be any naturally occurring amino acid, preferably Ala, Ser and Val
  misc_feature (235)..(235): Xaa can be any naturally occurring amino acid, preferably Ala, Ser and Val
  misc_feature (282)..(282): Xaa can be any naturally occurring amino acid, preferably Ala, Ser and Val
  misc_feature (343)..(343): Xaa can be any naturally occurring amino acid, preferably Ala, Ser and Val
  misc_feature (406)..(406): Xaa can be any naturally occurring amino acid, preferably Ala, Ser and Val
  misc_feature (462)..(462): Xaa can be any naturally occurring amino acid, preferably Ala, Ser and Val
  misc_feature (584)..(584): Xaa can be any naturally occurring amino acid, preferably Ala, Ser and Val
  misc_feature (708)..(708): Xaa can be any naturally occurring amino acid, preferably Ala, Ser and Val
  misc_feature (789)..(789): Xaa can be any naturally occurring amino acid, preferably Ala, Ser and Val
  misc_feature (828)..(828): Xaa can be any naturally occurring amino acid, preferably Ala, Ser and Val
MDKYISRKPLSFYFEELVNMFMESVNNAEIDDSKHHEIELILFKPPIITLTNLYYIASSMESYIEFTMLPINKPNTKFRNRMSLSKIHGLDVKNNQLVENIDNIIWEQKTLIKKKDIADNSSXVIRYSIEEKTLFVDYKKYNSSIKLELVNLIRTRLRNIVIDFKMKYFLGSGAQSASSSSLLXALNHPKNKPSLILEFEIMIQDKTVTRNMLLDELXMVANALFLSEPRHVRLXPYLQPKLKTYLLKKQELINIDTDNLYITGKTDGIFSYVYIYHRSIFXYFNHLGYIKDYDISVDVEEPIYLYAEMRKENNIIYFTVIKVLLPELDDRLAELEFVNSNLXNLHERLVFSTKQFEGPFESTSGLVDGIEEMLKKEREGVILFYSKGNDSMLDYKIKKDNTIDQXVNIIYRYMSSEPIVYNDKGSFIEYKKYSNDKGFPKEFGTGKLVIGNGVDYINNIYXLEFTNINPATGIDKIILPIKFISEFSHNDELIQPRIDKTMKYLYEHSYYGNQLSVIMEHISDQKLKLGDIFEEEKLAEVAHLQLKDSMRLNPEGQYFLTNRVRGALGVLSNYVKTLMISMYXSKAYLDDHNKRKVLAIDFGNGADLEKYFYGEIALMVATDPDDNAIETGKKRYNKLNSGDKSKYYKFDYIKETIRSGSYVSSIRQVFYFGRFSLVDWQFAIHYSFNPKHYNTIMSNLRELTASGXKILISTMDGDYIDTLKEKKKFVIHKLLPESENYLSIEKIDDDQILVYNPSSMTKPMAEYIVRKNTLIRVFREYGFQLLDVXNFKTIINRNIDFVEGVSRLENRGSTKNFFELNRKALSEXAGTDVLELLGYYVVYVFSKVC

SEQ ID NO: 286 - protein, 847 aa, Artificial sequence
  Catalytic polypeptide variant, all Cys substituted, Terminal introduced Cys
  misc_feature (121)..(121): Xaa can be any naturally occurring amino acid, preferably Ala, Ser and Val
  misc_feature (234)..(234): Xaa can be any naturally occurring amino acid, preferably Ala, Ser and Val
  misc_feature (281)..(281): Xaa can be any naturally occurring amino acid, preferably Ala, Ser and Val
  misc_feature (354)..(354): Xaa can be any naturally occurring amino acid, preferably Ala, Ser and Val
  misc_feature (386)..(386): Xaa can be any naturally occurring amino acid, preferably Ala, Ser and Val
  misc_feature (405)..(405): Xaa can be any naturally occurring amino acid, preferably Ala, Ser and Val
  misc_feature (461)..(461): Xaa can be any naturally occurring amino acid, preferably Ala, Ser and Val
  misc_feature (583)..(583): Xaa can be any naturally occurring amino acid, preferably Ala, Ser and Val
  misc_feature (707)..(707): Xaa can be any naturally occurring amino acid, preferably Ala, Ser and Val
  misc_feature (787)..(787): Xaa can be any naturally occurring amino acid, preferably Ala, Ser and Val
  misc_feature (826)..(826): Xaa can be any naturally occurring amino acid, preferably Ala, Ser and Val
MDNYILEKPLGSHFEELVDTFFEAIRNVSEVDKSKHHEVEMQIFKPSIITLSNLYNISTTTESYIEFSMMPIDKKNTKYRNRIPLSKIHGLDIKNSQLVENLDGFIWEEKTLISEKRVSEXTNIRIRHSVEQKTLFVDYKRRNGSIRLELVSVVRATLRNIVVDFKIKYFLGSGAQSASSLLYALNNPKNKPNLYLEFEISTSDKNISKQLLLNELNTIGNALFLSKVDKIRLXPRIKLVLKTYLLKKQEIINLNIENLYITSKTDGVFTYVLLQNKSIYXYFSHLGYIKEYTANREIDEKVYLYAEMRKENGILYFTVIKVLNPRMKNRLDELKFVNKNLQNINDRLVFVTKXYEGPFDSTSDLVFAIEEMLKSEHEGVIIFYSXGEESSLDYKIKKDNTIDQXVNVIYRYMSSEPVVFSDNGPFIEYKRYSDDKDFPKEFATGKLSLGNDVKYLNNIYXIEFTNLPEHTGVEKIIVPIKFIAEFSFNDKMIQPRIDKTMRYLYTENYYGNQLSVIIDHLNDQKINIGDVFEEDKLAEVAHKQLKDSLRLNPEGNYFIANKKRSALGVLSNYVKTLLISLYXSKAYLDDHSKRKVLAIDFGNGADLEKYFYGEIALMVATDPDEMAIETGKKRYNNLNSRDKSKYYKFNYIQETIRSPTYVDSIREVLYFGKFSIVDWQFAIHYSFHPIHYSTIMKNLYELTESGXKVLISTMDGDYLDTLKDKKKFIIYKSPETENYLSVEKIDNDKILVYNPSSMTKPMAEYIVRKDTLVRVFKEYQFSLIDNXSFKTIIDRSINFVKGVSRLETRDSTKNFLELNRNALEDXEGTDVLELLDHYMIYVFSKNC

SEQ ID NO: 287 - protein, 853 aa, Artificial sequence
  Catalytic polypeptide variant, all Cys substituted, Terminal introduced Cys
  misc_feature (12)..(12): Xaa can be any naturally occurring amino acid, preferably Ala, Ser and Val
  misc_feature (185)..(185): Xaa can be any naturally occurring amino acid, preferably Ala, Ser and Val
  misc_feature (236)..(236): Xaa can be any naturally occurring amino acid, preferably Ala, Ser and Val
  misc_feature (257)..(257): Xaa can be any naturally occurring amino acid, preferably Ala, Ser and Val
  misc_feature (283)..(283): Xaa can be any naturally occurring amino acid, preferably Ala, Ser and Val
  misc_feature (328)..(328): Xaa can be any naturally occurring amino acid, preferably Ala, Ser and Val
  misc_feature (356)..(356): Xaa can be any naturally occurring amino acid, preferably Ala, Ser and Val
  misc_feature (463)..(463): Xaa can be any naturally occurring amino acid, preferably Ala, Ser and Val
  misc_feature (472)..(472): Xaa can be any naturally occurring amino acid, preferably Ala, Ser and Val
  misc_feature (587)..(587): Xaa can be any naturally occurring amino acid, preferably Ala, Ser and Val
  misc_feature (711)..(711): Xaa can be any naturally occurring amino acid, preferably Ala, Ser and Val
  misc_feature (792)..(792): Xaa can be any naturally occurring amino acid, preferably Ala, Ser and Val
  misc_feature (831)..(831): Xaa can be any naturally occurring amino acid, preferably Ala, Ser and Val
MDKYISKKPLSXYFEELVDTFISVVNDIDKVNESKHHEVELILFKPPIITLTNLYNMATATESYIEFTMLPVDKPNTKFRNRIPLSKIHGLDVKNNQLVESLDGFIWEEKSLLLKKDISDNSSAVIRHSVEEKTLFVDYKRRNASIKLELVSLVRAKLRNIVIDFKMKYFLGSGAQSANSSSLLXALNHPKNKPSLYIEFEIMTQDKNISKKKLLEELNMSASALFLSQPKYIRLXPSINPILRTHLLKKQDIINLXTEDLYITSKTDGIFSHIYIEKKSIFXYFGHLGYIKEYTASRELEEPIYLYAEMRKEESILYLTVIKVVKPXMEDRLSELEFVKNNLTSIHDRLVFVTKXYDGPFESSSDLVASIEELLKTEQEGIILFYSKGENSTTDYKVKKDNTIDQTVNVIYRYMSSEPIVFNDKGSFLEYKRYSNDKGFPKEFSTGKLDLGEGVEYVNNIYXIEIKKLNPXTGITNLVLPIKFIAEFSHNDELIQPRIDKTMKYLYENSYYGNQLSVIMDHLNDQKLRIGDVFEEEKLADVAAAHIKLKDSMRLNPDGNYFLSSRVRGALGVLSNFVKTLLISLYXSKTYLDNHSKRKVLAIDFGNGADLEKYFYGEIALMVATDPDDNAIETGKKRYNERNAGDKSKYYKFNYIKETIRSETYVSSIRQVLYFEKFNLVDWQFAIHYSFHPKHYSTIMTNLHELTESGXKVLITTMDGDYLDTLKEKKKFIIRRLLPETENYLSIEKIDDDKVLVYNPSSMSKPMAEYIVRRETLIRVFRDYKFKLIDSXSFKTIIDRNISFINGVSRLESRGSTKNFFDLNRKALEEXDDTDVLELLSHYMVYVFSKEVC

SEQ ID NO: 288 - protein, 852 aa, Artificial sequence
  Catalytic polypeptide variant, all Cys substituted, Terminal introduced Cys
  misc_feature (12)..(12): Xaa can be any naturally occurring amino acid, preferably Ala, Ser and Val
  misc_feature (185)..(185): Xaa can be any naturally occurring amino acid, preferably Ala, Ser and Val
  misc_feature (236)..(236): Xaa can be any naturally occurring amino acid, preferably Ala, Ser and Val
  misc_feature (283)..(283): Xaa can be any naturally occurring amino acid, preferably Ala, Ser and Val
  misc_feature (328)..(328): Xaa can be any naturally occurring amino acid, preferably Ala, Ser and Val
  misc_feature (356)..(356): Xaa can be any naturally occurring amino acid, preferably Ala, Ser and Val
  misc_feature (407)..(407): Xaa can be any naturally occurring amino acid, preferably Ala, Ser and Val
  misc_feature (463)..(463): Xaa can be any naturally occurring amino acid, preferably Ala, Ser and Val
  misc_feature (472)..(472): Xaa can be any naturally occurring amino acid, preferably Ala, Ser and Val
  misc_feature (586)..(586): Xaa can be any naturally occurring amino acid, preferably Ala, Ser and Val
  misc_feature (710)..(710): Xaa can be any naturally occurring amino acid, preferably Ala, Ser and Val
  misc_feature (791)..(791): Xaa can be any naturally occurring amino acid, preferably Ala, Ser and Val
  misc_feature (830)..(830): Xaa can be any naturally occurring amino acid, preferably Ala, Ser and Val
MDKYISKTPLSXYFEELVDTFISVVNSINKVDESKHHEVELILFKPPIITLTNLYNMATTTESYIEFTMLPVDKPNTKFRNRIPLSKIHGLDVKNNQLVESLDGFIWEEKSLLLKKDISDNSSAIIKYSIEEKTLFVDYKRRNASIKLELVSVVRAKLRNIVIDFKMKYFLGSGAQSANSSSLLXALNHPKNKPSLYIEFEIMMQDKNISKKKLLEELNMSASALFLSHPKYIRLXPSINPILRTHLLKKQDIININTDDLYITSKTDGIFSHVYIEKKSIFXYFSHLGYIKEYTASREIEETIYLYAEMRKEESILYLTVIKVLKPXMEDRLSELAFVKNHLTGIHDRLVFVTKXYDGPFESSSDLVVSIEEMLKTEQEGIILFYSKGEDSTTDYKVKKDNTIDQXVNVIYRYMSSEPIVFNDKGSFLEYKRYSNDKGFPKEFSTGKLDLNGSVEYINNIYXIEIKHLNPXTGITNLVLPIKFIAEFSHNDELIQPRIDKTMKYLYESGYYGNQLSVIMDHLNDQKLRIGDVFEEEKLADIAAHMKLKDSMRLNPDGNYFLSNRVRGALGILSNFVKTLLISLYXSKTYLDNHSKRKVLAIDFGNGADLEKYFYGEIALMVATDPDDNAIETGKKRYNERNAGDKSKYYKFNYIKETIRSETYVSSIRQVLYFEKFSLVDWQFAIHYSFHPKHYSTIMTNLQELTESGXKVLITTMDGDYLDTLKEKKKFIIRKLLPETENYLSIEKIDDDKVLVYNPSSMSKPMAEYIVRRDTLIRVFREYKFKLIDSXNFKTIIDRNISFINGVSRLESRGSTKNFFELNRKALEEXNDTDVLELLSHYMVYVFSKEVC

SEQ ID NO: 289 - protein, 849 aa, Artificial sequence
  Catalytic polypeptide variant, all Cys substituted, Terminal introduced Cys
  misc_feature (217)..(217): Xaa can be any naturally occurring amino acid, preferably Ala, Ser and Val
  misc_feature (280)..(280): Xaa can be any naturally occurring amino acid, preferably Ala, Ser and Val
  misc_feature (369)..(369): Xaa can be any naturally occurring amino acid, preferably Ala, Ser and Val
  misc_feature (390)..(390): Xaa can be any naturally occurring amino acid, preferably Ala, Ser and Val
  misc_feature (459)..(459): Xaa can be any naturally occurring amino acid, preferably Ala, Ser and Val
  misc_feature (586)..(586): Xaa can be any naturally occurring amino acid, preferably Ala, Ser and Val
  misc_feature (846)..(846): Xaa can be any naturally occurring amino acid, preferably Ala, Ser and Val
MENKLGEPLSAMLDELVDYFESAFRENRFDAARHNEVELILLNPPLSAVSVLHTIATVEESYVQYVLKAKDAKIRNRLSVKDVHGLDVKNYQLVERLDDANWERKAPVWEKSFPGATIKHSTEESHPFTDYRNYSGNIKLEFVNLVRARAKHLIVDAKFKYFIGNGSQNYNSLLYALNDPAAKPGVTLEFEIDVSREHLEREGFSFAELRASLYTVXQALFLAPADSVFLVQGGGPRPPVPTNMLKKYQLQTLETADLYVTEKTDGVLTYVLLRDKDIFXHFAHLGYFIRYRGRRKFAEPVSLMGEMTRAGSGEKVVHFIKLQTPALPDRLEERAFVEERLSDLGGGITIAVKRYHGPYATNGDLIAAXATLLREYREGVILFYRHAAPXDWKLKKVNTVDQAVNVVYRYMSNEPIILGDRDTFVEFKRYSNAHGTPKEFGFGKLVLSDGVNYLGNIYXLEFLQSEHDTGLERVLVPVKFVGEFSTAEGDDSLVRPRLEKTMLYLYSRNYYGNQEAVILEHLEDQRVRLGELLTGAPDVMAEAGKRVARDALRLNPDGSYFSQNRTRGPLGILSNFVKTQTISLYXSKTFMDNNAKRKVLAVDFGNGADLEKYFYAEAAVLIATDPDPAAIAEANSRYNKLNSGSKSKYYKFAYLQATIRSDAYLDEVRKTFYSGRFDVIDWQFAVHFSFHPLHYSTVMRNLAELAAPGAKVLITTMDGDYVASLAEERRFVIHRTQAEDNYLSIEKISDEKALVFSPTTMKRPMEEYIVRRADLNRVFEEYGFRAIDYVTFYDVIARNRKFLAGVSKLEARPSTSKFFALNRDAVNFEGTDLEELLRRYVVYVFXKAC

SEQ ID NO: 290 - protein, 874 aa, Artificial sequence
  Catalytic polypeptide variant, all Cys substituted, Terminal introduced Cys
  misc_feature (103)..(103): Xaa can be any naturally occurring amino acid, preferably Ala, Ser and Val
  misc_feature (170)..(170): Xaa can be any naturally occurring amino acid, preferably Ala, Ser and Val
  misc_feature (318)..(318): Xaa can be any naturally occurring amino acid, preferably Ala, Ser and Val
  misc_feature (339)..(339): Xaa can be any naturally occurring amino acid, preferably Ala, Ser and Val
  misc_feature (394)..(394): Xaa can be any naturally occurring amino acid, preferably Ala, Ser and Val
  misc_feature (465)..(465): Xaa can be any naturally occurring amino acid, preferably Ala, Ser and Val
  misc_feature (489)..(489): Xaa can be any naturally occurring amino acid, preferably Ala, Ser and Val
  misc_feature (621)..(621): Xaa can be any naturally occurring amino acid, preferably Ala, Ser and Val
  misc_feature (724)..(724): Xaa can be any naturally occurring amino acid, preferably Ala, Ser and Val
MNNTGSEIVAEYGKMYEKIRESNMDLEITELEFTQFDPSLLSLSKMFSNPNIKPLTDSYLEYILNKTSDEGNNIKIRIRIDFAVVGGLELNNKQLLDYVEHGXWESKETKDIWLSPDEFGRITSATEKQGTYINKVIQSGKINMIFVNRARVKFSDFVVDFKLKRKLGNXRQGNISNLYKSVNNAMYPPNPSLEIEHTGQFKKPWKDVKLEFTKVISWIIGHPIEEILTTTTPLFKIIPTSVITPAYLMNSIDPTQHKLTPKINGVGVMFKIDKKHVLVQQMLGPKVISIWRYKHLLTVTEDIYGSGEFIFDSDHSKXIYPYMILGHDVSTYKWEVQDXANLPYDHVLIKSKQWTGPFNDITDMLTAIYEMTVSKHSYETDGLILSSSYRHGKXDYKIKATSDIDIVGKVRFTYAGKSDPRQMATDGMILTVDYMSKNATNELVKINDNRIKLSPEFDYLNDIFXVKTTRVDPQLVKLSHAVVPIGFIXEYDVRTKEIMIRLTKSSTHLWTKYLGNNWTTIQTIQHSVPILADLKLLSKWIKSPEARDHTVLQDVKINGTKSMNEMDDGLDPDRLNPKTTYFKENRIRSPLGYISNFVKSLLISLYASKMFYSNSKKARVXSIDFGNGADLTKYFYAGIQELIATDPDSAAIDTAHDRYMKLNKNEKSNYYRFNYLKTSIRNENFVSVIRTVTDQLNFDVIDWQFAAHFSWNHKHIQNIMHSLXEITKPGGRVLITTMNGKGLESILDKDDSVTFKIHPIEPTGYTTITKTSPTTFSVLTPLTTTTAMTEYIIDPDQMIKTFYDYGFVLLDQGRFDEVFNINVPFFKAGSLLETRPSTASFFAQQRGVVHDIKNTQLDQLLKYYIYMVFQRGTC

SEQ ID NO: 291 - protein, 892 aa, Artificial sequence
  Catalytic polypeptide variant, all Cys substituted, Terminal introduced Cys
  misc_feature (52)..(52): Xaa can be any naturally occurring amino acid, preferably Ala, Ser and Val
  misc_feature (289)..(289): Xaa can be any naturally occurring amino acid, preferably Ala, Ser and Val
  misc_feature (303)..(303): Xaa can be any naturally occurring amino acid, preferably Ala, Ser and Val
  misc_feature (509)..(509): Xaa can be any naturally occurring amino acid, preferably Ala, Ser and Val
  misc_feature (625)..(625): Xaa can be any naturally occurring amino acid, preferably Ala, Ser and Val
  misc_feature (756)..(756): Xaa can be any naturally occurring amino acid, preferably Ala, Ser and Val
MEYEINVLIKEFIEFYNNVTYIDDDKLHNEVEITYLFPNLILLSNLYQYDEXKKTTYLEFSLSYTDNKKRIKFRQIVPYTTQDKFEIKNSYLANKLFNVNKLDIKSEISNKNILLNESNKEKIIFRHSTEKKIIDSDITLPSKQELLKNQVRLTFVNSIRIMIDNLIKIEFKYKANLGSASSNSLALSTYLNNIDTARILTTYYLEIELLSNTKIDNDILINVLNKSFGYIFSIRNLDNFSLSISNEYVPIKTFMITYDKLHIIDKSAYVMTPKINGESVSFYVENGIXNITIYNFIYKNINXNINKNVIMSGEGELIIIDNIKHIFPFYFNLIKDNKISYTDRYKQIEFYNTSIINFKSNMKIHFRNKNIFKFESNNTVNEVLKFYRSILINDMYKDINDGVILLDISNNNVKKDYKFKLDNTVDIIAKLETHKGIFRTQKDGLYLTLSLYNYDNKNFVKMLEINLKNEDLTTMIHDKKLISYDNVINMLLFKNVDFGPKILVSPIYXIVEYSFMSSTIIKLRIEKTNKFFRNNYNGNNLNVILSSKQFHEKYNMLSVIDNKLDYMIELNKSNNLLTEETHRSKLILNKDVQNYFLEQTTRTSLNILTNYIKTEAISITVSKLXSIIPNRHVLSIDIGRGGDLRKYYYVGISGMLGTEPDISALETARSRYKEFQISSRAKSSVYKFNSINISILDDNYINRVKEIYLIPQRIKFFGVIEWQLAIHYSYNEDTKNNILYKLKNLAGDGTKIIITXLNGDLLSEKLQNNPHLNYKISDTIYYKISKIDDNRISVLYNATMSTWLEEFLIKKTIINDFKNYNFVLDDIFTFDKIFNNDINKMLRVLAVFNRKSTKDFYSNIINDKNIYENKELQELLSFFIVYIFRYSSSLTC

SEQ ID NO: 292 - protein, 861 aa, Artificial sequence
  Catalytic polypeptide variant, all Cys substituted, Terminal introduced Cys
  misc_feature (276)..(276): Xaa can be any naturally occurring amino acid, preferably Ala, Ser and Val
  misc_feature (479)..(480): Xaa can be any naturally occurring amino acid, preferably Ala, Ser and Val
  misc_feature (596)..(596): Xaa can be any naturally occurring amino acid, preferably Ala, Ser and Val
  misc_feature (727)..(727): Xaa can be any naturally occurring amino acid, preferably Ala, Ser and Val
MEFNINSIIDKFWQFYSTHNPVDNVHNEIELTYLFDNLLLLSNIASYTETKKKLQLEYIIKYVDKSIKLRQRHEYDYPNFEITNTYMIQKLTNQWTIKKLINKIEENIGNEKFIIAHNTEEDNIKNNMIIPPKKLIMSNVTIHILSSIYFIINGNVRVEFKLKGTLGAADNNKMMLQTYLNNVLTYKQFTSYYIEIEILNKLSKDEFYRDITNAFRYIYSINNLNNFALSTKNISPSVKTFMLPFDSLYLMDKSKYFLTSKIDGEVVQFTVKNGIXDIVLYNFIFKNKQTNIPNHIVMKGFGEYKKIDNVKTIYPFVFTEIYSTDSKQKYNTRYEMIKFYNDNIKNKEFDITFKHKPIIPIEKDIVNEAIAYYKSLDEKITDGVILLDKESNIDYKLKIDNTVDVIASLNTHKSPNKIHKDGIYMTFNLYMNDEKNITELLKVEMKSNDLITYDNDINMLKFKNIHNRYGKNILYAPLXXIVEYSFLKSKIVNIRLDKTTKFFKSNYYGNSLKVILDSKTFHEKYVPLDTVGIDYLYTMFKINNEIYDKKNLILNQNVEKYFKEPIENNQQQRPPLNIFTNLIKTEAISIAASKLXAEIPNRHVLSIDIGRGGDINKYYYIGISGMLGTDPDISALSEAQERYNSLQTRKRVNSTVYKFSSLNISILDHDYLNKVKSTYMTQQKIKYFGLIEWQMAIHYSYNVDTKNKILNILKNLSTDGTKVIITXLNGNKIKNLLINNQNIKYKIQDNIYYNISKVNDDKIKVLYDATMTTWLEEYLIYDTIIEDFNKYNFILDDMFEFKDIYNNDAMLVLKTNSLFPRKATSVFYKNILNQNTKDNQVLELMNLFKVYIFKYKSYKKC

SEQ ID NO: 293 - protein, 873 aa, Artificial sequence
  Catalytic polypeptide variant, all Cys substituted, Terminal introduced Cys
  misc_feature (12)..(12): Xaa can be any naturally occurring amino acid, preferably Ala, Ser and Val
  misc_feature (280)..(280): Xaa can be any naturally occurring amino acid, preferably Ala, Ser and Val
  misc_feature (294)..(294): Xaa can be any naturally occurring amino acid, preferably Ala, Ser and Val
  misc_feature (352)..(352): Xaa can be any naturally occurring amino acid, preferably Ala, Ser and Val
  misc_feature (423)..(423): Xaa can be any naturally occurring amino acid, preferably Ala, Ser and Val
  misc_feature (495)..(495): Xaa can be any naturally occurring amino acid, preferably Ala, Ser and Val
  misc_feature (738)..(738): Xaa can be any naturally occurring amino acid, preferably Ala, Ser and Val
  misc_feature (810)..(810): Xaa can be any naturally occurring amino acid, preferably Ala, Ser and Val
  misc_feature (871)..(871): Xaa can be any naturally occurring amino acid, preferably Ala, Ser and Val
MSIDVSDIINDXIKFYSNINFDSNPNVNNEIEFTYINPDLRILSNIYTDNNESKKKTYLEYVLKFANKKSKLRQKYKYDYPTFEIANSYFLDKLTNNWERKTIISEDKININKNEYILLRHNTEYQDNDIELPLLNDILDKINVLFVSQLYIIINDLIKVEFKIKSNIGPLSSNKLLLSTHFNDIETYRKNITYYLEIEVLSKTKLDNNVLYDNLVKSFEYIYKSKNISNISLVTIKNKPKIKTHMIQYNKLNTIDKESYIMAIKIDGDVVEFNVMNGIXNIIIYDMVYKNFSXNIDKNIQMIGMGEYIKVDNVKKIYPFYFSKLSYNNKKIINNILDRYKQIQYYNDNLLXHKPNMQIKFENKLTLKFDENNVTTNVLKFYKSIENSSFKNIYDGIVLLDITDNDSKKDYKFKIDNTVDVIXKLDTYRGTYILHNDNKLYITFTLYQYDNKNFTEILKYEEKNEIIEYNNYVNLLIFNNNNKFGPKKMLSPIWXIVEYSFLESKIIGLRIDKTNNFYRQNYNGNNLDVILTSKHIHEEFPSNYNIDYLMSLNETINVIDNNPHRSKLLLNKEVNKYFMNNTIRTSINILTNYLKTNGISMAISKLVTTLPNRYVLSIDIGRGGDLTKYYYVGITGMLGTDPDIFAIKEARDRYKKLQTISNAQASIYKFDSLNMSILNDNYENEIKNKFMTHHKIQYFGVIEWQLAIHYSYNNNTKDMILLKLKNLSNDGTKVIITXLDGDEITNRLNENPNLIYNIQPGITYKISKISDDKISVLYNATMTEWLEEYIITDKIIDDFAMYNFILSDVXKFDDIFKYNSDKSVEVLSNFLRKSTKKFYNDIKNDKNIYNNDDIKKIMSLFKVYTFVYSSXKC

SEQ ID NO: 294 - protein, 873 aa, Artificial sequence
  Catalytic polypeptide variant, all Cys substituted, Terminal introduced Cys
  misc_feature (280)..(280): Xaa can be any naturally occurring amino acid, preferably Ala, Ser and Val
  misc_feature (294)..(294): Xaa can be any naturally occurring amino acid, preferably Ala, Ser and Val
  misc_feature (423)..(423): Xaa can be any naturally occurring amino acid, preferably Ala, Ser and Val
  misc_feature (495)..(495): Xaa can be any naturally occurring amino acid, preferably Ala, Ser and Val
  misc_feature (738)..(738): Xaa can be any naturally occurring amino acid, preferably Ala, Ser and Val
MSIEINEIINKFVKFYDNIKLDTNENIKNEVELTLINPDLMLLSNIYTENNESKKKTYLEYNLKFSKKKSKLRQRHEYDYSTYEIPNSHLTDRLTNNWETKTVIDEEKIDINKHEHVLMRHNIEYIDNNIELPLINDIFDRISVIFVSQVYIIIDSVLKIEFKIKSYIGPLSSNKLSLSTHFNDIDTSRKNISYYLEIEILPNIKLENNILQEKLEKAFSYIYKSTNISNLSLVTIKEPSRIKTFTIQYNKLNTIDKDSYVMAIKIDGNVVNFTVKNSIXSVIIYNVIYKNYKXNIDKNIEIKGMGEYIKVNNVKKIYPFYFTEIKYVNRKATNIIENRYDQIQFYNSIITSFKEPMQIKFENKLTLKFNENNVSTNVVNFYKSIDNSNMKDIYDGIILIDISNNKDKKDYKFKIDNTVDIVXRLDTYRGVYILHSGGKLHISFSLFAYDDKNFAELTKYTVKSDIIKYISDANLLVFNNNDKFGPSKLLSPIYXIVEYSFLHSKIIGLRIDKTNNFYRQNYNGNSLDVIILSKQIHEQFPSNYNIDYLLSLNESSNIIDNNPHRSKLLLNKKVDKYFLDNTVRTSINILTNYMKTNAISMSISRLVTVLPNRYVLSIDIGRGGDLTKYYYVGISGILGTDPDTIAIQESRERYKNLQLKSNAQSSVYKFHTLNISILNDNYENDVKQSFMNQQKINFFGVIEWQLAIHYSYNNNTKDSILLKLKNLSSNGTKVIITXLDGNELINRLNINEHIIYNIQPGITYKITKISEDRISVLYNATMTNWLEEYIITDGIIYDFAKYNFILHDMFTFEDIFNKNTYKTIDILSNFGRKSTNMFYKTIKNDSNIYNNEDINKLMSLFKVYIFIYSSYNC

SEQ ID NO: 295 - protein, 873 aa, Artificial sequence
  Catalytic polypeptide variant, all Cys substituted, Terminal introduced Cys
  misc_feature (280)..(280): Xaa can be any naturally occurring amino acid, preferably Ala, Ser and Val
  misc_feature (294)..(294): Xaa can be any naturally occurring amino acid, preferably Ala, Ser and Val
  misc_feature (423)..(423): Xaa can be any naturally occurring amino acid, preferably Ala, Ser and Val
  misc_feature (495)..(495): Xaa can be any naturally occurring amino acid, preferably Ala, Ser and Val
  misc_feature (738)..(738): Xaa can be any naturally occurring amino acid, preferably Ala, Ser and Val
MSIDITDIINKYVQFYDKVNLDNNPNINNEVELTYINPDLMLLSNIFTDNNESKKRTYLEYNLRFTNKKSKLRQRHKYDYPTFEIANSYFLDNLTNNWEKKTIIYEEKIDINKNEHILLRHNTEYQDNDIELPLLKDILDKINVIFVSQVYIIINNIIRVEFKIKSNIGPLASNKLLLSTHFNDMETYRKNISYYMEIEILSNIKLDNTTLRDNLIKAFEYIYKSKNILNLSLVTIKNSPKLKTHMVQYNKLNSIDKDAYIMTIKIDGDVVEFNVKNGIXNIIIYNIIYKNFTXNIDKNIQMRGLGEYIKINNIRKIYPFYFFELSYTNKKIITNISDRYQQIQYYNNNLMTFKSSLQIKFENKLTLKFDENNVSTNVINFYKSIDNSNLKDIYDGVILLDISDNNLKKDYKFKIDNTVDVIXKLDTYRGTFILHKDNMLYITFTLYQYDNKNFTEILKYEVKNDIIEYNNYVNLLLFTNNNKFGPIKLVSPIYXIVEYSFLQSKIIGLRIDKTNNFYRQNYNGNNLDVIITSKQIHEQFPLNYNIDYLISLNNTTNIIDNNPHRSKLLLNKEVNKYFIDNTIRTSINILTNYIKTNAISMSISKLVTTIPNRYVLSIDIGRGGDLTKYYYVGITGMLGTDPDVFAIEEARDRYKKLQLKSNAQSSVYKFHTLNMSILNDKYEQEIKNNFMNQHKISFFGVIEWQLAIHYSYNDNTKDSILLKLKNLSRNGTKIIITXLDGNELINRLNINPNLIYNIQSGITYKISKVSDNKISILYNATMTEWLDEYIITNDIIDDFAKYNFILDDVFTFNDIFNDNTHKSIEVLSTFSRKSTNLFYATIKNDNNIYNNEDIKKLMSLFKVYVFIYSSHNC

SEQ ID NO: 296 - protein, 873 aa, Artificial sequence
  Catalytic polypeptide variant, all Cys substituted, Terminal introduced Cys
  misc_feature (280)..(280): Xaa can be any naturally occurring amino acid, preferably Ala, Ser and Val
  misc_feature (294)..(294): Xaa can be any naturally occurring amino acid, preferably Ala, Ser and Val
  misc_feature (423)..(423): Xaa can be any naturally occurring amino acid, preferably Ala, Ser and Val
  misc_feature (495)..(495): Xaa can be any naturally occurring amino acid, preferably Ala, Ser and Val
  misc_feature (738)..(738): Xaa can be any naturally occurring amino acid, preferably Ala, Ser and Val
MSIDITDIINKYLQFYDKVNLDNNPNINNEVELTYINPDLMLLSNIFTDNNESKKRTYLEYNLRFTNKKSKLRQRHKYDYPTFEIANSYFLDNLTNNWEKKTIIYEEKIDINKNEHILLRHNTEYQDNDIELPLLKDILDKINVIFVSQVYIIINNIIRVEFKIKSNIGPLASNKLLLSTHFNDMETYRKNISYYMEIEILSNIKLDNTTLRDNLIKAFEYIYKSKNISNLSLVTIKNSPKLKTHMIQYNKLNIIDKDAYIMTVKIDGDVVEFNVKNGIXNIIIYNIIYKNFTXNIDKNIQMRGLGEYIKVNNIRKIYPFYFFELSYTNKKIITNISDRYQQIQYYNNNLMPFKTSLQIKFENKLTLKFDENNVSTNVINFYKSIDNSNLKDIYDGVILLDISDNNLKKDYKFKIDNTVDVIXKLDTYRGTYILHKDNMLYITFTLYQYDNKNFTEILKYEVKNDIIEYNNYVNLLLFTNNNKFGPIKLVSPIYXIVEYSFLQSKIIGLRIDKTNNFYRQNYNGNNLDVIITSKQIHEQFPLNYNIDYLISLNDTKNIIDNNPHRSKLLLNKDVNKYFIDNTIRTSINILTNYIKTNAISMSISKLVTTIPNRYVLSIDIGRGGDLTKYYYVGITGMLGTDPDVFAIEEARDRYKKLQLKSNAQSSVYKFHTLNMSILNDKYEQEIKNNFMNQHKISFFGVIEWQLAIHYSYNDNTKDSILLKLKNLSRNGTKIIITXLDGNELINRLNVNPNLIYNIQSGITYKISKVSDNKISILYNATMTEWLDEYIITNDIIDDFAKYNFILDDVFAFNDIFNDNTQKSIEVLSTFSRKSTNLFYTTIKNDNNIYNNEDIKKLMSLFKVYVFIYSSHNC

SEQ ID NO: 297 - protein, 870 aa, Artificial sequence
  Catalytic polypeptide variant, all Cys substituted, Terminal introduced Cys
  misc_feature (280)..(280): Xaa can be any naturally occurring amino acid, preferably Ala, Ser and Val
  misc_feature (294)..(294): Xaa can be any naturally occurring amino acid, preferably Ala, Ser and Val
  misc_feature (420)..(420): Xaa can be any naturally occurring amino acid, preferably Ala, Ser and Val
  misc_feature (492)..(492): Xaa can be any naturally occurring amino acid, preferably Ala, Ser and Val
  misc_feature (735)..(735): Xaa can be any naturally occurring amino acid, preferably Ala, Ser and Val
MSIDINDIISKYIKFYENVKFDTSKNVNNEVELTYINPDLMLLSNIFTDNNESKKKTYLEYNLKFINKNSKLRQIHKYNYSTFEIANSYFLDKLTNNWENKTVLSEEKIDINKQEHILLRHNIEYQDDEVKLPLLNDLLDKINVIFVSHVYIIINSIIRVEFKIKSNIGPLSSNKLLLSTHFNDIDTYRKNISYYLEIEVLPQAKVDSKILYENLIKAFEYVYKSKNISNISILKTKEIPKIKTHMIQYNKLNTIDKDSYILAVKIDGDVVEFNVKNGIXNITIYNNIYKNFTXNIDKNIQMRGLGEYIKVNNIKKIYPFYFYEISYVDKNNIIDRYEQIQFYNNNLLNYKNAMQIKFEIKLVLKFDENNVSTNVLNFYKSIDKSNLKDIYDGVILLDTSNNNLKKDYKFKIDNTIDIVXKIDTYRGIFVLHNDNNLYITFTLYQYDNKNFVEISKYEVKNDIIKYNNYANLLIFNNINKFGPNKLLAPVYXIVEYSFLQSKIIGLRIDKTNNFYRQHYNGNNLEVILMSKQIHEQYPKNYNIDYLMSLNESINIIDNNPHRSKLLLNKNINKYFMDNTVRTSINILTNFIKTNAISISISKLVAVLPNRYVLSIDIGRGGDLTKYYYVGITGILGTDPDPFAIQEARDRYKKLQLKSNAQSSVYKFHTLNISILDDKYIQEIHRNFMSQQKIKYFGIIEWQLALHYSYNNNTKNTILRNIKTISGDGTKLIITXLDGNELLNRLSVNPNLIYNIQPGITYKISKISDEKISVIYNATMSDWLEEYIITDSIISDFEKYNFIIHDMFSFNDIFNDDTQKLIDVLSTFSRKSTNIFYNNIKNDSNIYNNDDIKKLMALFKVYVFIYSSSNC

SEQ ID NO: 298 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDSAIMVASDVXKKNLDLFMSHVKSVTKSSSWKDVNSVQFSILNDPVDTEFINKFLEFSNRVYEALYYVHSLLYSSMTSDSKSIENKHQRRLVKLLLC

SEQ ID NO: 299 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDTAIMVASDVXKKNLDLFMSHVKSVTKSSSWKDVNSVQFSILNDPVDTEFINKFLEFSNRVYEALYYVHSLLYSSMTSDSKSIENKHQRRLVKLLLC

SEQ ID NO: 300 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDSAIMVASNVXKKNLDLFMSHVKSVTKSSSWKDVNSVQFSILNDPVDTEFINKFLEFSNRVYEALYYVHSLLYSSMTSDSKSIENKHQRRLVKLLLC

SEQ ID NO: 301 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIVKNIREGTHVLLPFYETLPELNLSLGKSPLPSLEYGANYFLQISRVNDLNRIPTDMLKLFTHDIMLPESDLDKVYEILKINSVKYYGRSTKADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDSAIMVASDVXKKNLDLFMSHVKSVTKSSSWKDVNSVQFSILNDPVDTEFINKFLEFSNRVYEALYYVHSLLYSSMTSDSKSIENKHQRRLVKLLLC

SEQ ID NO: 302 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDSAIIVASDVXKKNLDLFMSHVKSVTKSSSWKDVNSVQFSILNDPVDTEFINKFLEFSNRVYEALYYVHSLLYSSMTSDSKSIENKHQRRLVKLLLC

SEQ ID NO: 303 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDEIVKNIREGTHVLLPFYETLPELNLSLGKSPLPSLEYGANYFLQISRVNDLNRMPTDMLKLFTHDIMLPESDLDKVYEILKINSVKYYGRSTRADAVVADLSARNKLFKRERDAIKSNNHLTENNLYISDYKMLTFDVFRPLFDFVNEKYXIIKLPTLFGRGVIDTMRIYXSLFKNVRLLKXVSDSWLKDSAIMVASDVYKKNLDLFMSHVKSVTKSSSWKDVNTVQFSILNDPVDTEFINKFLEFSNRVYEALYYVHSLLYSSMTSDSKSIENKHQRRLVKLLLC

SEQ ID NO: 304 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDEIIKNIREGTHILLPFYETLPELNLTLGKSPLPSLEYGTNYFLQISRVNDLNRMPTDMLKLFTHDIMLPESDLDKVYKILNINSVKYYGRSTKADAVVADLSARNKLFKRERDAIKSNNHLTENNLYISDYKMLTFDVFRPLFDFVNEKYXIVKLPTLFGRXVVDTMRIYXSLFKNVRLLKXVSDSWLKDSAIMVASDVXKKNMDLFMSHVKSVTKSSSWKDANSVQFSILNDPVDTEFINKFLEFSNRVYEALYYVHSLLYSSMTSDSKSLENEYQRRLVKLLLC

SEQ ID NO: 305 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MESIIKNIKDGIYILLPYYENLPDLDLVLGKTPLPSLEYGTNYFLHISRVNDLNRMPTDMLKLFTHNIMLPENDLEKVYDILNIKSVKSYGRTIKADAIVADLSARNKLFKKEREGIKSNNYLTENNLYVSDYTMLTLDIFRPLFDIVSEKYXIVKLPTLFGRXVIDSMRIYXSIFKNVRLFKXVSDSWLKDSSIMVASDINKKNLDIFMLHIRSVTKSNIWKDSNSVQFSILKEPVDKEFINKFLEFSNKVYESLYYIHSLLYLSMTSDSKSIENEYQRRLAKALLC

SEQ ID NO: 306 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
METIIKNIKDGVYTLLPFYESLPELNLSLGKSPLPSLEYGANYFLQLSRVNDLNRFPTDLLSLFTHDLMLPENDLESVYDILKIQSVKSYGKSIKADAVVADLSAKNKLFKKDRELIKSNNYLTENNLYISDYKMLTFEVFRPLFDFVSEKYXIVKMPTLFGRGIIDTMRVYXSLFKSVKMFKXTNDSWLKDSAIMVATDVYKKNMDEFMSHVRSVTKSSNWKDSNNVQFTILQESVDREFIDKFLDFSTSVYESLYYVHSLLYSSMISPNKSIENEFQKKLTKLLLC

SEQ ID NO: 307 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDKITRNIREGIHILLPFYENLPDISLSLGKSPLPSLEYGTNYFLQLSRVNDLNRLPTDMLSLFTHDIMLPETDMEKVYDILNIKSVKSYGKSIKADAVVADLSARNRLFKKDRELIKSNNYLTDNNLYISDYKMLTFEVFRPLFDLSSEKYXIVKLPTLFGKXVIDTIRVYXSLFKSVRLFKXASDSWLKDSAIMVASDIYKKNIDIFMSHIRSVLKSQYWKDSNNVQFSILKESVDKEFINKFLEFSTSVYESLYYVHSLLYSSMISDNKSIENEYQKKLTKLLLC

SEQ ID NO: 308 - protein, 288 aa, Artificial sequence
  Regulatory polypeptide variant, all Cys substituted, Terminal introduced Cys
  misc_feature (7)..(7): Xaa can be any naturally occurring amino acid, preferably Ala, Ser and Val
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
  misc_feature (208)..(208): Xaa can be any naturally occurring amino acid, preferably Ala, Ser and Val
MEQITKXIKEGTHTLFPFYDDLPDINLFLGKSPLPSLEYGANYFLQLSRVNDLNRLPTDLLSLFTHEIMIQENDLEKVYDILNIHSVKSYGKTIKADAVVIDLSAKNKLFKRDRELIKSNNYLTENNLYISDYKMLTFEVFRPLFEMSSEKYXIIKLPTLFGKXVIDTTRIYXSLFKSVRLFKXANDSWLKDSAIIVASNAXKKNIDXFMSHVRSVTKSLNWKESNNVQFSILKDSVDKEFIDKFLNFSTKVYESLYYVHSLLYASMTSESKSIENEYQKKLTKLLLC

SEQ ID NO: 309 - protein, 288 aa, Artificial sequence
  Regulatory polypeptide variant, all Cys substituted, Terminal introduced Cys
  misc_feature (7)..(7): Xaa can be any naturally occurring amino acid, preferably Ala, Ser and Val
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
  misc_feature (202)..(202): Xaa can be any naturally occurring amino acid, preferably Ala, Ser and Val
MDQIAKXIKEGTHTLFPFYDNLPDVNLFLGNSPLPSLEYGANYFLQLSRVNDLNRLPTDLLSLFTHEIMVQENDLEKVYDILNIHSVKSYGKTIKADAVVIDLSAKNKLFKKDRELIKSNNYLTENNLYISDYKMLTFEVFRPLFEMSSEKYXIIKLPTLFGRXVIDTTRVYXSLFKSVRLFKXANDSWLKDSAIIVASNAXKKNIDYFMSHIRSVTKSLNWKESNNVQFSILKDSVDKEFIDKFLNFSTKVYESLYYVHSLLYSSMTSESKSIENEYQKKLTKLLLC

SEQ ID NO: 310 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDQVTKNIKEGVHTLLPFYESLPELHLVFGKSPLPGLEYGANYFLQLSKLNDLNRLPTDLLSLFTHDLITPETDLEKVYKTLNIKSVKSYGKSTKADAIVADLSAKNRLFKKDRDLVKSNNYLTENNLYIGDYKMLTFEVFRPLFDIVSERFXIIKLPTLFGKGVIDVTRVYXSLFKSVRLIKXASDSWLKDSAIIVAEQVYKKNMDEFMTYVRHVTKSPTWKDSNNVQFSILKTSVDKEFIDKFLNFSNSVYESLYYVHSLLYASMTSERKSIENEYQKKLMKILLC

SEQ ID NO: 311 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDQVTKHIKEGVHTLLPFYDSLPELHLVFGKSPLPGLEYGANYFLQLSKLNDLNRLPTDLLSLFTHDLITPETDLEKVYKTLHIKSVKSYGKSTKADAIVADLSAKNRLFKKDRDLVKSNNYLTENNLYIGDYKMLTFEVFRPLFDIASERFXIIKLPTLFGRGVVDVLRVYXSLFKSVRLFKXASDSWLKDSAIMVAEHVHKKNMDEFMTYIRHVTKSPTWKDSNNVQFSILKTSADKEFIDKFLNFSNAVYESLYYVHSLLYASMTSERKSIENEYQKKLMKILLC

SEQ ID NO: 312 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDEVIKNIKEGIYILLPFYEHLPDLNLTLGKSPLPSLEYGTNYFLQLSRVNDLNRLPTDLLSLFTHDLMIPETDLEKVYEILNIKSIKSYGKNIKADAVVADLSAKNKFFKKERDLIKSNNYLNENNLYVSDYKMLTFEVFRPLFEISVEKFXIIKLPTLFGRXIVDTLRVYXSLFKSVRLFKXASDSWLKDSAIMVASEPYKKNFDSFMTEIKKTTKSSIWKDDNNVQFNILEYPVDKEFINKFLEFSTSVYESLYYVHSLLYSSMTSENKSIENEYQKKLVKILLC

SEQ ID NO: 313 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDDVIKNIKEGIYILLPFYEHLPDLNLTLGKSPLPSLEYGTNYFLQLSRVNDLNRLPTDLLSLFTHDLMIPETDLEKVYEILNIKSIKSYGKNIKADAVVADLSAKNKFFKKERDLIKSNNYLNENNLYVSDYKMLTFEVFRPLFEMSVEKFXIIKLPTLFGRXIVDTLRVYXSLFKSVRLFKXASDSWLKDSAIMVASEPYKKNFDSFMAEIKKTTKSSIWKDANNVQFNILEYPVDKEFINKFLEFSTSVYESLYYVHSLLYSSMTSENKSIENEYQKKLVKILLC

SEQ ID NO: 314 - protein, 288 aa, Artificial sequence
  Regulatory polypeptide variant, all Cys substituted, Terminal introduced Cys
  misc_feature (153)..(153): Xaa can be any naturally occurring amino acid, preferably Ala, Ser and Val
  misc_feature (164)..(164): Xaa can be any naturally occurring amino acid, preferably Ala, Ser and Val
  misc_feature (173)..(173): Xaa can be any naturally occurring amino acid, preferably Ala, Ser and Val
  misc_feature (184)..(184): Xaa can be any naturally occurring amino acid, preferably Ala, Ser and Val
MDDVIKNIKEGIYILLPFYKHLPDLNLTLGKSPLPSLEYGTNYFLQLSRVNDLNRLPTDLLSLFTHDLMIPETDLEKVYEILNIKSIKSYGKNIKADAVVADLSAKNKFFKKERDLIKSNNYLNENNLYVSDYKMLTFEVFRPLFEMSVEKFXIIKLPTLFGRXIVDTLRVYXSLFKSVRLFKXASDSWLKDSAIMVASEPYKKNFDSFMAEIKKTTKSSIWKDTNNVQFNILEYPVDKEFINKFLEFSTSVYESLYYVHSLLYSSMTSENKSIENEYQKKLVKILLC

SEQ ID NO: 315 - protein, 285 aa, Artificial sequence
  Regulatory polypeptide variant, all Cys substituted, Terminal introduced Cys
  misc_feature (150)..(150): Xaa can be any naturally occurring amino acid, preferably Ala, Ser and Val
  misc_feature (170)..(170): Xaa can be any naturally occurring amino acid, preferably Ala, Ser and Val
  misc_feature (181)..(181): Xaa can be any naturally occurring amino acid, preferably Ala, Ser and Val
MDSIIKDGIHVLMPFYENLPELNLTFGKSPLPSLEYGANYFLQLSKVNDLNRLPTDLFSLYTHDLIQPETDLEKIYDILDIKSVKSYGKTIKSDAIVADLSAKNRLFKKDRDLIKSNNYLTENNLFISDYKMITFEIFRPLFDISNEKYXIIKIPTLFGRTIVDTIRIYXSIFKTVRMFKXVSDSWFKDSAVMVASGLYKKNLDIFLTYIRSVIKTNNIKNYNNQQFNIVKSPTDKEFIDKFLEFSIPIYEALYYIHSLLLSSMTSKNKSIENEFQKKLTRLLLC

SEQ ID NO: 316 - protein, 293 aa, Artificial sequence
  Regulatory polypeptide variant, all Cys substituted, Terminal introduced Cys
  misc_feature (32)..(32): Xaa can be any naturally occurring amino acid, preferably Ala, Ser and Val
  misc_feature (157)..(157): Xaa can be any naturally occurring amino acid, preferably Ala, Ser and Val
  misc_feature (177)..(177): Xaa can be any naturally occurring amino acid, preferably Ala, Ser and Val
  misc_feature (188)..(188): Xaa can be any naturally occurring amino acid, preferably Ala, Ser and Val
MESAVAAVREVVRDGISMLLPFYETLPELHLXLGKNHLPSLEYGTNYFLQLSKVNDLNRMSTDMLRLFTHDIAIPETDLEKIYGVLGVKNVKSYGRGIKADAVVVDLGARNKIYKKDRDFVRSNNYLTENNLYMSDYKLLTFEVFRPVFEFSSEKYXIVKLPTAFGRGVVNVARVYXSLFRTVRLIKXASDSWLKDSFVIVASEPHAANMARFASYVASVTRSSTWKESNNVQFTILDEPVEREFIDKFLAFSARVYQALYYIHSLLYASMTSESKSIENEHQKRIMKLLAGC

SEQ ID NO: 317 - protein, 296 aa, Artificial sequence
  Regulatory polypeptide variant, all Cys substituted, Terminal introduced Cys
  misc_feature (20)..(20): Xaa can be any naturally occurring amino acid, preferably Ala, Ser and Val
  misc_feature (160)..(160): Xaa can be any naturally occurring amino acid, preferably Ala, Ser and Val
  misc_feature (180)..(180): Xaa can be any naturally occurring amino acid, preferably Ala, Ser and Val
  misc_feature (189)..(189): Xaa can be any naturally occurring amino acid, preferably Ala, Ser and Val
  misc_feature (205)..(205): Xaa can be any naturally occurring amino acid, preferably Ala, Ser and Val
MAAPTGFAAQVHALVRDGLXADMPFYETLPELNLVFGKNHTPSLQYGANYFLQLSKVNDLNRMSTDMVNLYTHDLTAPETDLEKVYEEHGIESIKAYGKSIRADAIVADLSARNKLFKKERTFVKSNNYLKENNFYVSDYSMMTFEVFRPLFDLGSERFXIVKLPTLFGRTVANAVRVYXSLFRRVQLXKGASDSWLKDSALLVXRDAYTPNLERFLAYVRASTRSPAWREANNAPFTLLDAPVEREFLEQFLGFSNQVYMAIYYVHTLLYNSMTSESKSIENDFQRRLVRLLRSC

SEQ ID NO: 318 - protein, 291 aa, Artificial sequence
  Regulatory polypeptide variant, all Cys substituted, Terminal introduced Cys
  misc_feature (176)..(176): Xaa can be any naturally occurring amino acid, preferably Ala, Ser and Val
  misc_feature (187)..(187): Xaa can be any naturally occurring amino acid, preferably Ala, Ser and Val
MEATDAVRRSIREGLSVTLPTFETAPRLDLQLGAGHLPSLEYGANYFLQLSRVNDLNRMPTDMLRLYTHDLMTEERDVEKVLEAHGIASVRGVQRGGKADAVVLDLSARNKLYRKERGMIRSNNHLTENNLYVADYHAITFAVMRPLLEISQERFVVLKLPTLFGTDVVHALRVYXSLFGTVRLFKXVSDSWLKDSAVMVASDPRRQDIAKFVAHVRDRAKTASWRESLAVPFRILRDPVESEFVDRFLAFAGRVYDALYVTHSLLYESMTSESKSIENESQRKLKLLLQC

SEQ ID NO: 319 - protein, 290 aa, Artificial sequence
  Regulatory polypeptide variant, all Cys substituted, Terminal introduced Cys
  misc_feature (50)..(50): Xaa can be any naturally occurring amino acid, preferably Ala, Ser and Val
  misc_feature (175)..(175): Xaa can be any naturally occurring amino acid, preferably Ala, Ser and Val
  misc_feature (186)..(186): Xaa can be any naturally occurring amino acid, preferably Ala, Ser and Val
MDAIETVRRSIREGLSVTLPTFDSTPALDLQLGAGHLPSLAYGTNYFLQXSRVNDLNRMPTEMLSLYTHDLMIDERDVEKVLEAHGITSVRSGARGKADAVVLDLSARNRLYRKERGAIRSNNHLTENNLYVADYHAITFAVMRPLLEISQERFVVLKLPTLFGTDVVHALRVYXSLFGTVRLFKXVSDSWLKDSAVMVASEPRRAAIAAFATHVRERTKAAAWRDALAVPFRILRDPVESEFVDRFVAFATRVYEALYVTHSLLYESMTSESKSIENESQRKLKLLLQC

SEQ ID NO: 320 - protein, 301 aa, Artificial sequence
  Regulatory polypeptide variant, all Cys substituted, Terminal introduced Cys
  misc_feature (5)..(5): Xaa can be any naturally occurring amino acid, preferably Ala, Ser and Val
  misc_feature (61)..(61): Xaa can be any naturally occurring amino acid, preferably Ala, Ser and Val
  misc_feature (186)..(186): Xaa can be any naturally occurring amino acid, preferably Ala, Ser and Val
  misc_feature (197)..(197): Xaa can be any naturally occurring amino acid, preferably Ala, Ser and Val
MKTDXASNKSAMDAVEAVRRSIREGLSVTLPTFDSTPALDLQLGVGHLPSLAYGTNYFLQXSRVNDINRMPTEMLSLYTHDLMIDERDVEKVLEAHGITSVRSRARGRADAVVLDLSARNRLYRKERGAIRSNNHLTENNLYVADYHAITFAVMRPLLEITQERFVVLKLPTLFGTDVVHALRVYXSLFGTVRLFKXVSDSWLKDSAVMVASEPRRAAIAAFVTHVRERTKAAAWRDSLAVPFRVLKDPVESEFVDRFVAFASRVYEALYVTHSLLYESMTSESKSIENESQRKLKLLLQC

SEQ ID NO: 321 - protein, 290 aa, Artificial sequence
  Regulatory polypeptide variant, all Cys substituted, Terminal introduced Cys
  misc_feature (132)..(132): Xaa can be any naturally occurring amino acid, preferably Ala, Ser and Val
  misc_feature (154)..(154): Xaa can be any naturally occurring amino acid, preferably Ala, Ser and Val
  misc_feature (174)..(174): Xaa can be any naturally occurring amino acid, preferably Ala, Ser and Val
  misc_feature (199)..(199): Xaa can be any naturally occurring amino acid, preferably Ala, Ser and Val
MNTDKIAEIIKNGLYITMPFYETLPEMNLVFGKNHLPTLEYGTNYFLQLSKINDINRFSTDTLALFTHDLNKESDINKLYEPYNIETVKLYGKYIQADAVVVDLSAPNKLFKKEHPYYKSNNELKENNLYIXDYNMITFEVFRAIFEMSSEKIXIVKVPTLFGNTIINVIRIYXSLFKNVRLYKLSADSWLKDSAIIVXQSPHTSNINKFISHVRKVTKSHTWLDSNNKNFIILHNSVEKEFIEKFLSFSYKIYEVLFYVHSLLIDSMKSEQQSLDNEHQKKLIKLLRNC

SEQ ID NO: 322 - protein, 290 aa, Artificial sequence
  Regulatory polypeptide variant, all Cys substituted, Terminal introduced Cys
  misc_feature (132)..(132): Xaa can be any naturally occurring amino acid, preferably Ala, Ser and Val
  misc_feature (154)..(154): Xaa can be any naturally occurring amino acid, preferably Ala, Ser and Val
  misc_feature (174)..(174): Xaa can be any naturally occurring amino acid, preferably Ala, Ser and Val
  misc_feature (199)..(199): Xaa can be any naturally occurring amino acid, preferably Ala, Ser and Val
MNIDRITAFIKNGISVRMPFYDTLPEMDLVFGKNHLPSLEYGANYFLQLSKINDINRLSTEMLALYTHDLNKESDISKLFDSYNIKTIKSYGRSIQADAVFVDLRPSNSLYKNEHPYYKSNNYLKENNLYIXDYTMITFEIYRPIFELSTEKTXIIKVPTLFGKNIINAVRVYXSLFKYVKLYKLSADSWLKDSAIIVXQQPHTTNINKFITYIRKVTKSQTWVDSNNINFILIHDSVEKEFIEKFLSFSYKIYESLYYVHSLLYSSMTSDLQSLDNEYQKKLIKLLRGC

SEQ ID NO: 323 - protein, 290 aa, Artificial sequence; identical to SEQ ID NO: 322
  Regulatory polypeptide variant, all Cys substituted, Terminal introduced Cys
  misc_feature (132)..(132): Xaa can be any naturally occurring amino acid, preferably Ala, Ser and Val
  misc_feature (154)..(154): Xaa can be any naturally occurring amino acid, preferably Ala, Ser and Val
  misc_feature (174)..(174): Xaa can be any naturally occurring amino acid, preferably Ala, Ser and Val
  misc_feature (199)..(199): Xaa can be any naturally occurring amino acid, preferably Ala, Ser and Val

SEQ ID NO: 324 - protein, 290 aa, Artificial sequence
  Regulatory polypeptide variant, all Cys substituted, Terminal introduced Cys
  misc_feature (132)..(132): Xaa can be any naturally occurring amino acid, preferably Ala, Ser and Val
  misc_feature (154)..(154): Xaa can be any naturally occurring amino acid, preferably Ala, Ser and Val
  misc_feature (174)..(174): Xaa can be any naturally occurring amino acid, preferably Ala, Ser and Val
  misc_feature (199)..(199): Xaa can be any naturally occurring amino acid, preferably Ala, Ser and Val
MNIDRITSFIKNGISVRMPFYDTLPEMDLVFGKNHLPSLEYGANYFLQLSKINDINRLSTEMLALYTHDLNKESDISKLFDSYNIKTIKSYGRSIQADAVFVDLRPSNSLYKNEHPYYKSNNYLKENNLYIXDYTMITFEIYRPIFELSTEKTXIIKVPTLFGKTIINAVRVYXSLFKYVKLYKLSADSWLKDSAIIVXQQPHTANINKFITYIRKVTKSQTWVDSNNINFILIHDSVEREFIEKFLSFSYKIYESLYYVHSLLYSSMTSDLQSLDNEYQKKLIKLLRGC

SEQ ID NO: 325 - protein, 297 aa, Artificial sequence
  Regulatory polypeptide variant, all Cys substituted, Terminal introduced Cys
  misc_feature (11)..(11): Xaa can be any naturally occurring amino acid, preferably Ala, Ser and Val
  misc_feature (139)..(139): Xaa can be any naturally occurring amino acid, preferably Ala, Ser and Val
  misc_feature (161)..(161): Xaa can be any naturally occurring amino acid, preferably Ala, Ser and Val
  misc_feature (181)..(181): Xaa can be any naturally occurring amino acid, preferably Ala, Ser and Val
  misc_feature (190)..(190): Xaa can be any naturally occurring amino acid, preferably Ala, Ser and Val
  misc_feature (206)..(206): Xaa can be any naturally occurring amino acid, preferably Ala, Ser and Val
MEDNIKQQKNXDVTHIIRNGISKKLAFYESLPPMNLVFGKNHLPSLEYGANYFLQLSKINDINRLSTDMLALYTHDLNKESDIPKLYEPYNIKTIKSYGKYIQADAVVVDFSAQNMLFKKDHPFYKSNNYLKENNLYIXDYKMITFEIYRPVFELLSEKIXIIKVPTLFGRTIVNVLRVYXSLFKQVTIXKLPSDSWLKDSAIIIXQQPYSPNINKFTSYVKKVTGSQSWTDTNNRHFILIHDSIEPEFIELFLSFSYKIYEALYYVHSLLYNSMTSDAQSLDNDYQKKLIKLLRNC

SEQ ID NO: 326 - protein, 290 aa, Artificial sequence
  Regulatory polypeptide variant, all Cys substituted, Terminal introduced Cys
  misc_feature (132)..(132): Xaa can be any naturally occurring amino acid, preferably Ala, Ser and Val
  misc_feature (154)..(154): Xaa can be any naturally occurring amino acid, preferably Ala, Ser and Val
  misc_feature (174)..(174): Xaa can be any naturally occurring amino acid, preferably Ala, Ser and Val
  misc_feature (199)..(199): Xaa can be any naturally occurring amino acid, preferably Ala, Ser and Val
MNTDRITAFIKNGISARMPFYDTLPDMDLVFGKNHLPSLEYGANYFLQLSKINDINRLSTEMLSLYTHDLNKESDISKLFEPYNIKTIKSYGRSIQADAVVVDLRPSNSLYKNEHPYYKSNNYLKENNLYIXDYTMITFEIYRPIFELSTEKTXIIKVPTLFGKTIVNAVRVYXSLFRYVKLYKLSADSWLKDSAIIVXQQPHAANINKFITYIRKVTKSQTWLDSNNVNFILIHDSVERVFIEKFLSFSYKIYESLYYVHSLLYSSMTSDLQSLDNEYQKKLIKLLRGC

SEQ ID NO: 327 - protein, 290 aa, Artificial sequence
  Regulatory polypeptide variant, all Cys substituted, Terminal introduced Cys
  misc_feature (46)..(46): Xaa can be any naturally occurring amino acid, preferably Ala, Ser and Val
  misc_feature (130)..(130): Xaa can be any naturally occurring amino acid, preferably Ala, Ser and Val
  misc_feature (153)..(153): Xaa can be any naturally occurring amino acid, preferably Ala, Ser and Val
  misc_feature (173)..(173): Xaa can be any naturally occurring amino acid, preferably Ala, Ser and Val
  misc_feature (178)..(178): Xaa can be any naturally occurring amino acid, preferably Ala, Ser and Val
  misc_feature (198)..(198): Xaa can be any naturally occurring amino acid, preferably Ala, Ser and Val
MTEEEQIIRSGFGVTFPHYPALPSLDLVFGKNHLPSLEYGADYFLXLSKVNDLNRISTETLSLYTHGLMAAEDDLERAYASLGVKTVKTHGKTIHADAVVLDMSAYRKLYKTERAAIKSNNELNFNNLFXSNYDMLTFKVFRPLFFIGTEKYXVVKLPTLFGRTVANAVRVYXSVFKXVRLFKSPHDSWFKDSALMIXSGLDAGNLARLLTYLKKATRSNAWKDENDFKNYVLVRPSVEPQFLQVYVGFANPVYRAIFLVHTYLYESINSEAKSVQNEHQEKLLKILYKC

SEQ ID NO: 328 - protein, 334 aa, Artificial sequence
  Cap-methyltransferase variant, all Cys substituted, Terminal introduced Cys
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTADLLSNYALQNVMISILNPVASSLKWRXPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYXNKTFPTTKAKVLFLQQSIFRFLNIPTTSTEKVSHEPIQRKISSKDSMSKNRNSKRSVRGNKC

SEQ ID NO: 329 - protein, 334 aa, Artificial sequence
  Cap-methyltransferase variant, all Cys substituted, Terminal introduced Cys
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTADLLSNYALQNVMISILNPVASSLKWRXPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYXNKTFPTTKAKILFLQQSIFRFLNIPTTSTEKVSHEPIQRKISSKDSMSKNRNSKRSVRGNKC

SEQ ID NO: 330 - protein, 334 aa, Artificial sequence
  Cap-methyltransferase variant, all Cys substituted, Terminal introduced Cys
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRTIKKQLHPSKIILISDVRSKRGGNEPSTADLLSNYALQNVMISILNPVASSLKWRXPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYXNKTFPTTKAKVLFLQQSIFRFLNIPTTSTEKVSHEPIQRKISSKDSVSKNRNSKRSVRGNKC

SEQ ID NO: 331 - protein, 334 aa, Artificial sequence
  Cap-methyltransferase variant, all Cys substituted, Terminal introduced Cys
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKHLHPSKIILISDVRSKRGGNEPSTEDLLSNYALQNVMISILNPVASSLKWRXPFPDQWIKDFYIPHGNKMLQPFAPSYSAEMRLLSIYTGENMRLTRVTKSDAVNYEKKMYYLNKIVRNKVVVNFDYPNQEYDYFHMYFMLRTVYXNKTFPTTKAKVLFLQQSIFRFLNIPTTSTEKVSHEPIQRKVSSKDSVSKNRNSKRSIRGNKC

SEQ ID NO: 332 - protein, 334 aa, Artificial sequence
  Cap-methyltransferase variant, all Cys substituted, Terminal introduced Cys
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
  misc_feature (276)..(276): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLVDGRHHDPILNGLRDVTLVTRFVDEEYLRSIKKQLHPSKIILISDVRSKRGGNEPSTEDLLSNYALQNIMISILNPVASSLKWRXPFPDQWIKDFYIPHGNKMLQPFAPSYSAEMRLLSIYTGDNMRLTRVTKSDAVNYEKKMYYLNKIVRNKVVVNFDYPNQEYDYFHMYFMLRTVYXNKTXPTTKAKVLFLQQSIFRFLNIPTTSTEKVSHEPIQRKVSSKDSVSKNRNSKRSVRGNKC

SEQ ID NO: 333 - protein, 334 aa, Artificial sequence
  Cap-methyltransferase variant, all Cys substituted, Terminal introduced Cys
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
  misc_feature (311)..(311): Xaa can be any naturally occurring amino acid, preferably Ala, Ser and Val
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTEDLLSNYALQNVMISILNPVASSLKWRXPFPDQWIKDFYIPHGNKMSQPFAPSYSAEMRLLSIYTGENMRLTRVTKSDAVNYEKKMYYLNKIVRNKVVVNFDYPNQEYDYFHMYFMLRTVYXNKTFPTTKAKVLFLQQSIFRFLNIPTTSTEKVSHEPIQXKVSSKDSVYKNRNSKRSVRGNKC

SEQ ID NO: 334 - protein, 334 aa, Artificial sequence
  Cap-methyltransferase variant, all Cys substituted, Terminal introduced Cys
  misc_feature (178)..(178): Xaa can be any naturally occurring amino acid, preferably Ala, Ser and Val
  misc_feature (272)..(272): Xaa can be any naturally occurring amino acid, preferably Ala, Ser and Val
MDVVSLDKPFMYFEEIDNELEYEPESANEVAKKLPYQGQLKLLLGELFFLSKLQRHGILDGATVVYIGSAPGTHIRYLRDHFYNLGVIIKWMLIDGRHHDPVLNGLRDVTIVTRFVDEEYLRTIKKQLHPSKIILISDVRSKRGGNEPSTADLLSNYALQNIMVSILNPVASSLKWRXPFPDQWIKDFYIPHGNKMLQPFAPSYSAEMRLLSIYTGENMRLTRVTSSDAINYEKKMYYLNKIVRNRVVVNFDYPNQEYDYFHMFFMLRTVYXNKTFPNTKAKVLFLQQSIFRFLNIPTTSTEKVSHEPVQRKISSKDSVSKNRNSKRSVRGNKC

SEQ ID NO: 335 - protein, 334 aa, Artificial sequence
  Cap-methyltransferase variant, all Cys substituted, Terminal introduced Cys
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MDVVSMDKPFMYFEEIDGMLDYEHSSADEVAKKLPYQGQLKLLLGELFFLSKLQRHGILDGATVLYIGSAPGTHIRYLRDHFYNLGVIIKWMLIDGRHHNSILNGLRDVILITRFVDEDYLRILKKQLHPSKIILISDIRSKRRSGEPTTEDLLSNYALQNIMISILNPVASSLKWRXPFPDQWIKDFYIPHGNKMLQPFAPSYSAEMRLLSIYTSDAVRLTXVTKSDAINYEKKMYYLNKIVRNRVVVNFDYTNQEYDYFHMYYILRTIYTNKTFPTTKSKVLFLQQSIFRFLNIPTTTTEKIHYEPAQRKIPGKNIVSKNRNNTRPVRYNKC

SEQ ID NO: 336 - protein, 348 aa, Artificial sequence
  Cap-methyltransferase variant, all Cys substituted, Terminal introduced Cys
  misc_feature (59)..(59): Xaa can be any naturally occurring amino acid, preferably Ala, Ser and Val
  misc_feature (115)..(115): Xaa can be any naturally occurring amino acid, preferably Ala, Ser and Val
  misc_feature (192)..(192): Xaa can be any naturally occurring amino acid, preferably Ala, Ser and Val
  misc_feature (237)..(237): Xaa can be any naturally occurring amino acid, preferably Ala, Ser and Val
MIKLLKRRSKSTFKMEAISMDKPFMYFDEIDNELEYDPKSAEEKPKKLPYQGQLKLLLXELFFLSKLQRHGILDGATIIYIGSAPGTHIKYIRDHFLSMGLIIKWILIDGRKHDXILEGLRDVQLITKFVDESYIKFLKKKTFPSKIILISDVRSKRGGSEPSTNDLLSNYALQNIMVTILKPVASSLKWRXPFPDQWIKDFYIPYGNEMLQPFAPKYSAELRLISIYSGDPIKLRXITKEDALKYEKKMYYLNKVVRNKIVINFDYSNQEYDFFHMYHMLRTIYSNKPFISIKAKVLYFHQSIFKFLKIPLTYTEKINNEPTQRKISSKNTLSKNRSTKKSLRDNKC

SEQ ID NO: 337 - protein, 334 aa, Artificial sequence
  Cap-methyltransferase variant, all Cys substituted, Terminal introduced Cys
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
  misc_feature (311)..(311): Xaa can be any naturally occurring amino acid, preferably Ala, Ser and Val
MDAVSMEKPIMYLDEIDNELKYDPNSANEKNKKFPFQGQLKLLLGELFFLSKLQRHGILDGSTVLYIGSAPGTHIRYLRDHFISMGLVIKWMLIDGRHHDIILNGLRDVSLITRFVDESYIKLLKKQLYPSKIILISDIRSKRGGNEPSTEDLLSNYALQNIMVSVLQPVASSLKWRXPFPDQWLRDFYVPYGNEMLQPFAPLYSAELRLITIYSGEPIKLRXITINDAKKYEKKMFYVNKVIRNKIILNFDYPNQEYDFFHMYFMLKTVYYNKEFSSTKEKVLFFHQSIFKFLKIPIINTEKVNHEQPQXKVFGKNFMSKGGNNERSVRDNKC

SEQ ID NO: 338 - protein, 339 aa, Artificial sequence
  Cap-methyltransferase variant, all Cys substituted, Terminal introduced Cys
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MEPVSMDKPFMYFDEIDDELEYEPESVNETPKKLPHQGQLKLLLGELFFLSKLQRHGILDGSTIVYIGSAPGTHIKYLRDHFMSMGLVIKWMLIDGRTHDPILEGLRDVILITKFVDEAYIRQLKKQLYPSRVILISDVRSKRGQKEPTTQDLLSNYSLQNIMVSVLKPAASSLKWRXPFPDQWIKDFYVPHGNEMLQPFAPSYSAEMRLLSIYSGTPIRLKXITQQDSSKYEKKMYYLNKIIRNRIIINFDYSNQEYDFFHMYHMLKTVYSNKSFTSNKSKVLHFHQSIFRFLKIPITNTEKIHHEPTQRKVPSKNTMLKSRNTKKSVRGNKQGRRTC

SEQ ID NO: 339 - protein, 364 aa, Artificial sequence
  Cap-methyltransferase variant, all Cys substituted, Terminal introduced Cys
  misc_feature (208)..(208): Xaa can be any naturally occurring amino acid, preferably Ala, Ser and Val
  misc_feature (253)..(253): Xaa can be any naturally occurring amino acid, preferably Ala, Ser and Val
  misc_feature (341)..(341): Xaa can be any naturally occurring amino acid, preferably Ala, Ser and Val
MIHLTTTNFFKKYINYNLIKVRLLNIQHLKMDAVSMEKPIMYLDETNSEMDYDPNSANEKNKKFPFQGQLKLLLGELFFLSKLQRHGILDGSTVLYIGSAPGTHIRYLRDHFISMGLVIRWMLIDGRQHDIILNGLRDVSLITRFVDESYIKLLKKQLHNSKIILISDIRSKRGGNEPSTEDLLANYALQNIMVSVLQPIASSLKWRXPFPDQWLRDFYIPYGNEMLQPFAPAYSAELRLITIYSGEPIKLRXITKNDAKKYEKKMFYINKVIRNKIILNFDYPNQEYDFFHMYFMLKTVYYNKEFSSVKEKVLFFHQSIFRFLKIPIINTEKVKHEQSQXKIPGKNSMFKSGNIERPIRNNKC

SEQ ID NO: 340 - protein, 334 aa, Artificial sequence
  Cap-methyltransferase variant, all Cys substituted, Terminal introduced Cys
  misc_feature (45)..(45): Xaa can be any naturally occurring amino acid, preferably Ala, Ser and Val
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MEPLSIDKPFMYFDEINNELEYDPDSANEKHKKFPYQGQLKLLLXELFFLSKLQRHGILDGSTIVYIGSAPGTHIRYLRNHFVSMGLVIRWILIDGRKHDYILEGIRDITLITKFVDENYIRQLKKQLYPSKIILISDIRSKRGTSEPTTSDLLNNYTLQNIMVSILKPVASSLKWRXPFPDQWIKDFYIPYGNELLQPFAPTYSAEMRLISIYNNEPIRLRXITKEDALKYEKKMYYLNKIIRSKIVINFDYPNQEYDVFHMYHMLKTVYTNKNFISVKDKVLFIHQSIFKFLKIPITYSEKIRYEPTQRKVSSKDTMSKDRNIKKSVLGDKC

SEQ ID NO: 341 - protein, 339 aa, Artificial sequence
  Cap-methyltransferase variant, all Cys substituted, Terminal introduced Cys
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
  misc_feature (311)..(311): Xaa can be any naturally occurring amino acid, preferably Ala, Ser and Val
MEPVSMDKPFMYFDEIEDELEYEPESVNETPKKLPHQGQLKLLLGELFFLSKLQRHGILDGSTIVYIGSAPGTHIKYLRDHFVSMGLVIKWMLIDGRTHDTILEGLRDVILITKFVDEAYIRQLKKQLYPSRVILISDVRSKRGKKEPTTQDLLSNYSLQNIMVSVLKPAASSLKWRXPFPDQWIKDFYVPHGNEMLQPFAPSYSAEMRLLSIYSGTPIRLKXITQQDSLKYEKKMYYLNKIIRNRIIINFDYSNQEYDFFHMYHMLKTVYSNKSFTSNKSKVLHLHQSIFRFLKIPITNTEKIHHEPTQXKVSSKNTMLKSRNTKKPVRGNKQGRRTC

SEQ ID NO: 342 - protein, 334 aa, Artificial sequence
  Cap-methyltransferase variant, all Cys substituted, Terminal introduced Cys
  misc_feature (45)..(45): Xaa can be any naturally occurring amino acid, preferably Ala, Ser and Val
  misc_feature (62)..(62): Xaa can be any naturally occurring amino acid, preferably Ala, Ser and Val
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MEAVSMDKPFMYFDEIDNELEYDPKTSEEKPKKLPYQGQLKLLLXELFFLSKLQRHGILDGXTIVYVGSAPGTHIKYLRDHFLSMGLVIRWILIDGRQHDTILNGLRDVTLITKFVDESYIRVLKKQLYQSKIVLISDVRSKRGGNEPSTFDLLSNYALQNIMVSILKPAASSLKWRXPFPDQWVKDFYIPHGNEMLQPFAPKYSAEMRLISIYSGNPIKLRXITKDDSIKYEKKMFYFNKIIRNRIIINFDYSNQEYDFYHMYNMLKTVYSNKDFSSIKSKVLFFHHSIFKFLKIPIFNTEKINYEPAQRKILSKNIMFKNRNIKKSIRYNKC

SEQ ID NO: 343 - protein, 334 aa, Artificial sequence
  Cap-methyltransferase variant, all Cys substituted, Terminal introduced Cys
  misc_feature (45)..(45): Xaa can be any naturally occurring amino acid, preferably Ala, Ser and Val
  misc_feature (62)..(62): Xaa can be any naturally occurring amino acid, preferably Ala, Ser and Val
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MEAVSMDKPFMYFDEIDNELEYDPKTSEEKPKKLPYQGQLKLLLXELFFLSKLQRHGILDGXTIVYVGSAPGTHIKYLRDHFLSMGLVIRWILIDGRQHDTILNGLRDVTLITKFVDESYIRVLKKQLYKSKIVLISDVRSKRGGNEPNTFDLLSNYALQNIMVSILKPAASSLKWRXPFPDQWVKDFYIPHGNEMLQPFAPKYSAEMRLISIYSGNPIKLRXITKDDSIKYEKKMFYFNKIIRNRIIINFDYSNQEYDFYHMYNMLKTVYSNKDFSSIKSKVLFFHHSIFKFLKIPIFNTEKINYEPTQRKILSKNIMFKNRNIKKSIRYNKC

SEQ ID NO: 344 - protein, 334 aa, Artificial sequence
  Cap-methyltransferase variant, all Cys substituted, Terminal introduced Cys
  misc_feature (45)..(45): Xaa can be any naturally occurring amino acid, preferably Ala, Ser and Val
  misc_feature (62)..(62): Xaa can be any naturally occurring amino acid, preferably Ala, Ser and Val
  misc_feature (178)..(178): Xaa can be any naturally occurring amino acid, preferably Ala, Ser and Val
  misc_feature (223)..(223): Xaa can be any naturally occurring amino acid, preferably Ala, Ser and Val
MEAVSMDKPFMYFDEIDNELEYDPKTSEEKPKKLPYQGQLKLLLXELFFLSKLQRHGILDGXTIVYVGSAPGTHIKYLRDHFLSMGLVIRWILIDGRQHDTILNGFRDVTLITKFVDESYIRVLKKQLYQSKIVLISDVRSKRGGNEPSTFDLLSNYALQNIMVSILKPAASSLKWRXPFPDQWVKDFYIPHGNEMLQPFAPKYSAEMRLISIYSGNPIKLRXITKDDSIKYEKKMFYFNKIIRNRIIINFDYSNQEYDFYHMYNMLKTVYSNKDFSSIKSKVLFFHHSIFKFLKIPIFNTEKINYEPSQRKILSKNIMFKNRNIKKSIRYNKC

SEQ ID NO: 345 - protein, 334 aa, Artificial sequence
  Cap-methyltransferase variant, all Cys substituted, Terminal introduced Cys
  misc_feature (101)..(101): Xaa can be any naturally occurring amino acid, preferably Ala, Ser and Val
  misc_feature (178)..(178): Xaa can be any naturally occurring amino acid, preferably Ala, Ser and Val
  misc_feature (254)..(254): Xaa can be any naturally occurring amino acid, preferably Ala, Ser and Val
  misc_feature (311)..(311): Xaa can be any naturally occurring amino acid, preferably Ala, Ser and Val
MEPVSMENPLIYFDDIDDELEYDPNSSMEPIKKIPYQGQLKLLLGELFFLTKLQKHGILDGSTVVYIGSAPGIHIKYIRDHFLSMSVIIKWLLIDGRQHDXNLEGLRDVTVITKFVDETYIRKLQKKLYPSKIILISDIRSIRGGNEPNTYDLLNNYVLQNVMVSILKPVASSLKWRXPFPDQWVKDFYIPYGTEMLQPFAPKYSAEMRLITIYNNDPIKLRLITKKDAIKYEKKMYYFNKIVRNRIVINFDYXNQEYDFYHMYYILKTIYTNKVFTDIKSKVLYLHQSIFKFLKIPISSTEKIHYEPTQXKVSGKNIMSKNRSVKKSIRYNKC

SEQ ID NO: 346 - protein, 335 aa, Artificial sequence
  Cap-methyltransferase variant, all Cys substituted, Terminal introduced Cys
  misc_feature (179)..(179): Xaa can be any naturally occurring amino acid, preferably Ala, Ser and Val
  misc_feature (193)..(193): Xaa can be any naturally occurring amino acid, preferably Ala, Ser and Val
  misc_feature (224)..(224): Xaa can be any naturally occurring amino acid, preferably Ala, Ser and Val
  misc_feature (273)..(273): Xaa can be any naturally occurring amino acid, preferably Ala, Ser and Val
MNAEHMDRPYIYFDQLDGTRDYDSEKEASRKSERMPSQGQLKLLLGELFFLSKLQRYGLLDGSNIVYVGSAPGTHIRFLRDHFADLGVTLKWTLIDGRRHDGSLRGLRDVTLVTRFADEEYTRSLRRHLRGARVILISDVRSKRGGDEPSTEDLLRDYALQNTIVSILNPAAFSLKWRXPFPGQWVRDFYVPXGKEMLQAFAPPYSAELRILSISTGEPVKLRXINLDTASDYEKKMFFFNDVVRRRVVVNFDYPNQEYDYYHMYYLLRNVFXEKEFPSTKAKVLFLHHKIFKFLNIPLSPTERLRDEPVQRPLPSKDPVPEGGDRARPVRGDKC

SEQ ID NO: 347 - protein, 338 aa, Artificial sequence
  Cap-methyltransferase variant, all Cys substituted, Terminal introduced Cys
  misc_feature (77)..(78): Xaa can be any naturally occurring amino acid, preferably Ala, Ser and Val
  misc_feature (103)..(103): Xaa can be any naturally occurring amino acid, preferably Ala, Ser and Val
  misc_feature (179)..(179): Xaa can be any naturally occurring amino acid, preferably Ala, Ser and Val
  misc_feature (193)..(193): Xaa can be any naturally occurring amino acid, preferably Ala, Ser and Val
  misc_feature (273)..(273): Xaa can be any naturally occurring amino acid, preferably Ala, Ser and Val
MEGVEMEKPLLYFDELTGERDFDAAFAEANEPAKLPAQGQLKLLVGELVFLNRLYRHGMLDGSVIVYIGSAPGTHIXXLHSHFQELGVSLKWILVDGRKHDAXLMGLRNVTTVTRFADEAYLRELRAELKRAKVVLISDIRSNRVNTEPTTADLLRDYALQNVMVSVLKPIASSLKWRXPFPDSWEKDFYVPXGKEMLQPFAPPFSAEMRLLSVYADTPARLRLVTLSDAVKYEKRMFYLNSVVRRRVILNFDYPNQEYDFFHMFYLLSSVVXSKEFKSAKDKVLSLQQGFFRFLRIPAISTPGLRAPDDEPAQRAVPGKNSLPKGRGKKRSVRDHKC

SEQ ID NO: 348 - protein, 338 aa, Artificial sequence
  Cap-methyltransferase variant, all Cys substituted, Terminal introduced Cys
  misc_feature (77)..(78): Xaa can be any naturally occurring amino acid, preferably Ala, Ser and Val
  misc_feature (103)..(103): Xaa can be any naturally occurring amino acid, preferably Ala, Ser and Val
  misc_feature (179)..(179): Xaa can be any naturally occurring amino acid, preferably Ala, Ser and Val
  misc_feature (193)..(193): Xaa can be any naturally occurring amino acid, preferably Ala, Ser and Val
  misc_feature (273)..(273): Xaa can be any naturally occurring amino acid, preferably Ala, Ser and Val
  misc_feature (315)..(315): Xaa can be any naturally occurring amino acid, preferably Ala, Ser and Val
MEGVEMEKPLLYFDDIAGERDFDAAFAAENEPPKMPAQGQLKLLVGELVFLNRLYKHGLLDGSVIVYVGSAPGTHIXXLHSHFQELGVSLKWVLIDGRKHDSXLMGLRNVTTVTRFADEAYLRELKSSMRRSKIVLISDIRSNRVNTEPTTADLLRDYALQNVMVSVLRPIASSLKWRXPFPDSWERDFYVPXGKEMLQPFAPPFSAEMRLLTVHAETPARMRLVTLADAVRYEKRMFFLNSVVRRRVILNFDYPNQEYDFFHMFHLLSTVVXSREFKSAKDKVLSLQQSFFRFLRIPPLPTPGLRAPRDEPAQXAVPGKDPLPKGRGKKRPVRGDKC

SEQ ID NO: 349 - protein, 337 aa, Artificial sequence
  Cap-methyltransferase variant, all Cys substituted, Terminal introduced Cys
  misc_feature (46)..(46): Xaa can be any naturally occurring amino acid, preferably Ala, Ser and Val
  misc_feature (77)..(78): Xaa can be any naturally occurring amino acid, preferably Ala, Ser and Val
  misc_feature (103)..(103): Xaa can be any naturally occurring amino acid, preferably Ala, Ser and Val
  misc_feature (179)..(179): Xaa can be any naturally occurring amino acid, preferably Ala, Ser and Val
  misc_feature (193)..(193): Xaa can be any naturally occurring amino acid, preferably Ala, Ser and Val
  misc_feature (266)..(266): Xaa can be any naturally occurring amino acid, preferably Ala, Ser and Val
  misc_feature (273)..(273): Xaa can be any naturally occurring amino acid, preferably Ala, Ser and Val
  misc_feature (275)..(275): Xaa can be any naturally occurring amino acid, preferably Ala, Ser and Val
MEGVEMDKPLLYFDEIAGAREYDAAFAEKHEPPKIPGRGQMKLLVXELVFLNRLHLHGMLDGSVIVYVGSAPGRHIXXLHSHFQELGVSLKWVLIDGRKHDPXLSGLRNVTTVTRFADEAYLRELRGELRRSKIVLISDIRSNRVDTEPTTADLLRDYALQNTMVSVLKPVASSLKWRXPFPDSWEKDFYVPXGKEMLQPFAPPFSAEMRLLTVYSETRPKLRLITLSDAVNYEKRMFYLNSVVRQRVILNFDYPNQEYDFFHMFXLLSSVVXSXEFKSPKEKVLSLQNRFFRFLRIPPSITLGLRQHDEPPQHAVPGQDPLPKGRGKKRPLRGGKC

SEQ ID NO: 350 - protein, 343 aa, Artificial sequence
  Cap-methyltransferase variant, all Cys substituted, Terminal introduced Cys
  misc_feature (177)..(177): Xaa can be any naturally occurring amino acid, preferably Ala, Ser and Val
  misc_feature (191)..(191): Xaa can be any naturally occurring amino acid, preferably Ala, Ser and Val
  misc_feature (221)..(221): Xaa can be any naturally occurring amino acid, preferably Ala, Ser and Val
  misc_feature (270)..(270): Xaa can be any naturally occurring amino acid, preferably Ala, Ser and Val
MEAQAMERPLLYFHELTQTQEYDAEVERAARSRFPAQGQLKLLIGELFFLNKLHRREMLAGTTVVYIGSAPGGHIRYLVEHFRALGVPLRWMLLDGRSHDSRLQGLSDVTLVTRFVDERYLMRMRQALRGARVVLISDIRSRRGSEPSTEDLLYDYALQNSMLSILKPVASSLKWRXPFPDQWLHNFYVVXGKELLQPFAPPFSAELRLLSVHAGAPRLRXITLAAARDYEKKMFYLNNVIRRRIVLNFDYPNQEYDFFHMFHLLNTVLXPRSFDSPTKKVLFLQQSIFRFLGIQSPLPEKLPLPERPRKHEPAQRGVPGQDPVSEGRGRAKPVRGRQQGAPC

SEQ ID NO: 351 - protein, 337 aa, Artificial sequence
  Cap-methyltransferase variant, all Cys substituted, Terminal introduced Cys
  misc_feature (46)..(46): Xaa can be any naturally occurring amino acid, preferably Ala, Ser and Val
  misc_feature (77)..(78): Xaa can be any naturally occurring amino acid, preferably Ala, Ser and Val
  misc_feature (103)..(103): Xaa can be any naturally occurring amino acid, preferably Ala, Ser and Val
  misc_feature (179)..(179): Xaa can be any naturally occurring amino acid, preferably Ala, Ser and Val
  misc_feature (193)..(193): Xaa can be any naturally occurring amino acid, preferably Ala, Ser and Val
  misc_feature (266)..(266): Xaa can be any naturally occurring amino acid, preferably Ala, Ser and Val
  misc_feature (273)..(273): Xaa can be any naturally occurring amino acid, preferably Ala, Ser and Val
  misc_feature (275)..(275): Xaa can be any naturally occurring amino acid, preferably Ala, Ser and Val
MEGVEMEKPLLYFDEIAGARDYDAAFAERHEPAKIPGRGQMKLLVXELVFLNRLHLHGMLDGSVIVYVGSAPGRHIXXLHSHFQELGVSLKWVLIDGRKHDPXLSGLRNVTTVTRFADEAYLRELRADLRRAKIVLISDIRSNRVDTEPTTADLLRDYALQNTMVSVLKPVASSLKWRXPFPDSWEKDFYVPXGKEMLQPFAPPFSAEMRLLTVYSETRPKLRLITLSDAVNYEKRMFYLNSVVRQRVILNFDYPNQEYDFFHMFXLLSSVAXSXDFKSPKEKVLSLQNRFFRFLRIPPSITLGLRRHDEPPQHAVPGQDPLPKGRGKRRPLRGDKC

SEQ ID NO: 352 - protein, 303 aa, Artificial sequence
  Cap-methyltransferase variant, all Cys substituted, Terminal introduced Cys
  misc_feature (28)..(28): Xaa can be any naturally occurring amino acid, preferably Ala, Ser and Val
  misc_feature (30)..(30): Xaa can be any naturally occurring amino acid, preferably Ala, Ser and Val
  misc_feature (178)..(178): Xaa can be any naturally occurring amino acid, preferably Ala, Ser and Val
MNVIELSKPFIFYDELVHRLDYDKAIEXSXKAKFQGQGQLKLLLGELYFLNTLLRNNMLYSDMVIVYIGSAPGSHIKFLYSHLESLGIRLKWILIDGRDHDSSLSTLRNVTIIKRFVDEQYLFKLHEKLKKEKVILISDIRSLRGKEPTSEDLLHDYSLQNLMISILRPIASSLKWRXPFPDQWIRDFYIPLGDEFLQPFAPSYSAEMRLLGSYTRGPIRLIRITREAAVEYEKKMFYLNNKVRKSIVLDFDYPRQEYDFFHMFYILKDLIVSESLEFTTDKQKVIFLQDSIFKSLNIKPTPC

SEQ ID NO: 353 - protein, 301 aa, Artificial sequence
  Cap-methyltransferase variant, all Cys substituted, Terminal introduced Cys
  misc_feature (18)..(18): Xaa can be any naturally occurring amino acid, preferably Ala, Ser and Val
  misc_feature (30)..(30): Xaa can be any naturally occurring amino acid, preferably Ala, Ser and Val
  misc_feature (36)..(36): Xaa can be any naturally occurring amino acid, preferably Ala, Ser and Val
  misc_feature (60)..(60): Xaa can be any naturally occurring amino acid, preferably Ala, Ser and Val
  misc_feature (178)..(178): Xaa can be any naturally occurring amino acid, preferably Ala, Ser and Val
MNILDAERPFMFYNELTXKQDYNKNIESSXKNKFPXQGQLKLLIGEIYFLNRLIKEDILXSNTVIIYIGSAPGNHIKFLHNYLNSINIYPKWILIDGRDHEASLEGLKDVTIVQRFVDEPYLFKLRNITKKDKVVLISDIRSLRGKEPTTEDLLHDYALQNMMISILAPVASSLKWRXPFPEQWLDDFYIPYGEEFLQPFAPTFSAEMRILGIYVKAPIRLLRINKDIALEYEKKMFYLNNIIRRSIVLDFDYPIQDYDFFHMFHILKDIVIPESLQFLTDKQKVIFLQDSIFKSLNIRKC

SEQ ID NO: 354 - protein, 309 aa, Artificial sequence
  Cap-methyltransferase variant, all Cys substituted, Terminal introduced Cys
  misc_feature (67)..(67): Xaa can be any naturally occurring amino acid, preferably Ala, Ser and Val
  misc_feature (186)..(186): Xaa can be any naturally occurring amino acid, preferably Ala, Ser and Val
  misc_feature (200)..(200): Xaa can be any naturally occurring amino acid, preferably Ala, Ser and Val
  misc_feature (221)..(221): Xaa can be any naturally occurring amino acid, preferably Ala, Ser and Val
MHEGHQESFKELEMTKPYMFFNELVGEEDYNKELENSNTKFQGQGQLKLLLGELYFLNTLIKNKTLXSDTVIVYIGSAPGSHINFLYHYMDDLKIDLKWILIDGRDHDRSLESLKNVSIIHRFVDEQYLFKLRNMIRKNHKIVLISDIRSLRGKEPTSEDLLHDYALQNQMVSILKPIASSLKWRXPFPDQWIRDFYIPXGDEFLQPFAPPFSAEMRLLSXYSRAPIRLIRIDKNAAIEYEKKMFYLNTKIRPKIVLDFDYPNQKYDYFYMFYILKDIVLPTYKEFSTYKQKVIFLQEAIFNALNIKPC

SEQ ID NO: 355 - protein, 309 aa, Artificial sequence
  Cap-methyltransferase variant, all Cys substituted, Terminal introduced Cys
  misc_feature (67)..(67): Xaa can be any naturally occurring amino acid, preferably Ala, Ser and Val
  misc_feature (186)..(186): Xaa can be any naturally occurring amino acid, preferably Ala, Ser and Val
  misc_feature (200)..(200): Xaa can be any naturally occurring amino acid, preferably Ala, Ser and Val
  misc_feature (221)..(221): Xaa can be any naturally occurring amino acid, preferably Ala, Ser and Val
MHEGRKDTFKELEMTKPYMFFNELVGEEDYNKALEGSNTKFQGQGQLKLLLGELYFLNILIKNKTLXSDTVIVYIGSAPGSHINFLYHYMDDLKIDLKWILIDGRDHDQSLENLKNVSIIHRFVDEQYLFKLRNMIRKNNKIVLISDIRSLRGKEPTSEDLLHDYALQNQMVSILKPIASSLKWRXPFPDQWIRDFYIPXGDEFLQPFAPPFSAEMRLLSXYSRAPIRLIRIDKNAAIEYEKKMFYLNTKIRPKIVLDFDYPNQKYDYFYMFYILKDIVLPTSKEFSTYKQKVIFLQESIFTALNIKPC

SEQ ID NO: 356 - protein, 295 aa, Artificial sequence
  Cap-methyltransferase variant, all Cys substituted, Terminal introduced Cys
  misc_feature (176)..(176): Xaa can be any naturally occurring amino acid, preferably Ala, Ser and Val
  misc_feature (243)..(243): Xaa can be any naturally occurring amino acid, preferably Ala, Ser and Val
MAGTISMPKPYLFFSDLSGEEEYSADYEQRRFRSQGQLKLLLGELYFLDQLSKAGTLSGSPTVVYIGSAPGTHIRYLRDHFAKLGYELRWVLIDGREHDASLRGLPDVELVTRFVNEAYLHRLRAKLGDRAVVLISDIRAVRDGEPRTEDMLEDYRLQNKMVEVLKPVAFSLKWRXPFPDQWTKDFVVIKGAEFLQPFRPSYSTEMRLLSLNGRPLTIRHVTLDAAKEYERKLFYLNHRVRRXTVLSFDFYNQGYDYFHAYWLLKDLSYPAVFQSEKIKAAFLLQEIFDFLGIKC

SEQ ID NO: 357 - protein, 312 aa, Artificial sequence
  Cap-methyltransferase variant, all Cys substituted, Terminal introduced Cys
  misc_feature (16)..(16): Xaa can be any naturally occurring amino acid, preferably Ala, Ser and Val
  misc_feature (83)..(83): Xaa can be any naturally occurring amino acid, preferably Ala, Ser and Val
  misc_feature (183)..(183): Xaa can be any naturally occurring amino acid, preferably Ala, Ser and Val
  misc_feature (191)..(191): Xaa can be any naturally occurring amino acid, preferably Ala, Ser and Val
  misc_feature (250)..(250): Xaa can be any naturally occurring amino acid, preferably Ala, Ser and Val
  misc_feature (299)..(299): Xaa can be any naturally occurring amino acid, preferably Ala, Ser and Val
  misc_feature (310)..(310): Xaa can be any naturally occurring amino acid, preferably Ala, Ser and Val
MSANHKKFKSLTLETXPIMSFDQITKQLKWEKNMDKTVFPHKTNGQLKLLLGELLFFTEITRDTPLFNRENVNSFVVVYVGSXPGFHVPAIDYFFPGLTWELIDPTPMSVTLEKYVHRHKNRYTYTRDYADVKWAQHVVDKYPGKKIVLISDIRTSGDGEPTTQNLLDDYDLQEAIIKKLKPXAWMLKWRXPFPDSWPTTKEVKIPVGKIYVQAFAKPTSAELRIVNLTGNLTTNVVTKQEGVIYEEKMXYFNQVLRRSQITNGLYDLIFHDKLYAFEIATRIFNYAWTTHAPVLGRTXDKIYHIYTALXKC

SEQ ID NO: 358 - protein, 296 aa, Artificial sequence
  Cap-methyltransferase variant, all Cys substituted, Terminal introduced Cys
  misc_feature (53)..(53): Xaa can be any naturally occurring amino acid, preferably Ala, Ser and Val
  misc_feature (101)..(101): Xaa can be any naturally occurring amino acid, preferably Ala, Ser and Val
  misc_feature (202)..(202): Xaa can be any naturally occurring amino acid, preferably Ala, Ser and Val
MSIYMKINDFKKPNVLIFDNINNQLKYKPNNVSNKHPGQLKLLMTELQFFNNXNIDALNSKDRPIYVLYIGSGRGYHLIKLLDLYKDYNIKWYFYDPSGHXISLERMSQYVSINNDYFTEKNINEFKNKKPLLFISDIRSTDGSEPRTKNLIDDYKIQNNIVLNLRPLYSLLKFRYPFPDDFPPEIENEVYVDGIKFLQPFXGPQSTEMRIFVSEQNIILKNFSKEESILFEEKMYYYNKNYRIINKNDILIAGFILKSTNKFDNMKYIDIIKSLENSINNQIREDISFNKLDIKC

SEQ ID NO: 359 - protein, 267 aa, Artificial sequence
  Cap-methyltransferase variant, all Cys substituted, Terminal introduced Cys
  misc_feature (182)..(182): Xaa can be any naturally occurring amino acid, preferably Ala, Ser and Val
MNFPLYLNNAIFKSNNKINIDKLPLIGSLKNYLMMKMFIEKYVHTQDVTIIIIGSAPGMSITEIIIEYPYINFELYDNKQHAPLLYNFNNVKIYNKLFSLYDIKKYIDKNIYVYSDLRTNSKDVNLYNDIYNQHKFILHLNPISAMYKVKLPHINTNYKYIKLPIGIDIIQPFAEHTREYRXVQFKNNYRLNYYKIDTAIDYVAKLNYYNNISLLDKTINYKYAKYILKVNNIRHHITRLLYNFNKRKPLNNKRKIFIMNMKQMLYC

SEQ ID NO: 360 - protein, 259 aa, Artificial sequence
  Cap-methyltransferase variant, all Cys substituted, Terminal introduced Cys
  misc_feature (182)..(182): Xaa can be any naturally occurring amino acid, preferably Ala, Ser and Val
MNFPLYLNNAIFKSNNKINIDKLPLIGSLKNYLMMKLFIEKYVHTQDVTIIIIGSAPGMSITEIIVEYPYINFELYDNKQHAPLLYNFNNVKIHNKLFSLYDINKYIDKNIYVYSDLRTNSKDINLYNDIYNQHKFILHLNPISAMYKVKLPHISTNYKYIKLPIGIDIIQPFAEHTREYRXVQFKNKYRLRYYNIDTAIDYVTKLNYYNNISLLDKTINYKYAKYILKVNNIRHHITRLLYNFNKRKPLNNKRKILLC

SEQ ID NO: 361 - protein, 26 aa, Artificial sequence
  Linker element
SGGGSGGGGSGGGGSGGGGSGGGSLQ

SEQ ID NO: 362 - protein, 12 aa, Artificial sequence
  Linker element
AEAAAKEAAAKA

SEQ ID NO: 363 - protein, 46 aa, Artificial sequence
  Linker element
AEAAAKEAAAKEAAAKEAAAKALEAEAAAKEAAAKEAAAKEAAAKA

SEQ ID NO: 364 - protein, 5 aa, Artificial sequence
  Linker element
EAAAK

SEQ ID NO: 365 - protein, 10 aa, Artificial sequence
  Linker element
EAAAKEAAAK

SEQ ID NO: 366 - protein, 15 aa, Artificial sequence
  Linker element
EAAAKEAAAKEAAAK

SEQ ID NO: 367 - protein, 4 aa, Artificial sequence
  Linker element
GGGG

SEQ ID NO: 368 - protein, 5 aa, Artificial sequence
  Linker element
GGGGG

SEQ ID NO: 369 - protein, 6 aa, Artificial sequence
  Linker element
GGGGGG

SEQ ID NO: 370 - protein, 8 aa, Artificial sequence
  Linker element
GGGGGGGG

SEQ ID NO: 371 - protein, 5 aa, Artificial sequence
  Linker element
GGGGS

SEQ ID NO: 372 - protein, 6 aa, Artificial sequence
  Linker element
GGGGSG

SEQ ID NO: 373 - protein, 9 aa, Artificial sequence
  Linker element
GGGGSGGGG

SEQ ID NO: 374 - protein, 10 aa, Artificial sequence
  Linker element
GGGGSGGGGS

SEQ ID NO: 375 - protein, 10 aa, Artificial sequence
  Linker element
GGGGSGGGGS

SEQ ID NO: 376 - protein, 15 aa, Artificial sequence
  Linker element
GGGGSGGGGSGGGGS

SEQ ID NO: 377 - protein, 20 aa, Artificial sequence
  Linker element
GGGGSGGGGSGGGGSGGGGS

SEQ ID NO: 378 - protein, 16 aa, Artificial sequence
  Linker element
GGGSGGGGSGGGGSGG

SEQ ID NO: 379 - protein, 15 aa, Artificial sequence
  Linker element
GGSGGGGSGGGGSGG

SEQ ID NO: 380 - protein, 4 aa, Artificial sequence
  Linker element
GSGS

SEQ ID NO: 381 - protein, 21 aa, Artificial sequence
  Linker element
GSGGGGSAWSHPQFEKGGGGS

SEQ ID NO: 382 - protein, 5 aa, Artificial sequence
  Linker element
PAPAP

SEQ ID NO: 383 - protein, 11 aa, Artificial sequence
  Linker element
PPPGSRHDKIH

SEQ ID NO: 384 - protein, 4 aa, Artificial sequence
  Linker element
SGGG

SEQ ID NO: 385 - protein, 4 aa, Artificial sequence
  Linker element
GSGS

SEQ ID NO: 386 - DNA, 38 bp, Artificial sequence
  3042_CapTemp-fw
gacgtctaatacgactcactatagggatcgatcgatca

SEQ ID NO: 387 - DNA, 38 bp, Artificial sequence
  3042_CapTemp-rev
tgatcgatcgatccctatagtgagtcgtattagacgtc

The invention claimed is:
1. A method for producing capped ribonucleic acid (RNA) molecules, comprising:
i) contacting a viral capping enzyme being immobilized onto a solid support with RNA molecules, a nucleotide, and a methyl donor under conditions suitable for forming a 5'-cap0 structure, wherein the viral capping enzyme comprises a heterodimer of a catalytic polypeptide having an amino acid sequence at least 90% identical to SEQ ID NO: 1 having RNA triphosphatase (TPase), guanylyltransferase (GTase) and methyltransferase (MTase) activity, and a regulatory polypeptide having an amino acid sequence at least 90% identical to SEQ ID NO: 2, wherein the viral capping enzyme is immobilized onto the solid support by covalent binding, wherein the covalent binding is a disulfide bridge or a thioether bond; and ii) isolating the capped RNA molecules by filtration, chromatography, or centrifugation.

2. The method of claim 1, wherein the viral capping enzyme is immobilized by covalent binding to a thiol-activated solid support, haloacetyl functionalized solid support, pyridyl disulfide-functionalized solid support, maleimide-activated solid support, epoxy-activated solid support, or a mixture thereof.

3. The method of claim 1, wherein the viral capping enzyme is immobilized via a thiol group of at least one cysteine residue and wherein at least one cysteine residue of the viral capping enzyme is substituted with a different amino acid.

4. The method of claim 1, wherein the solid support comprises a material selected from the group consisting of agarose, silica, magnetic beads, methacrylate beads, and nanoparticles.

5. The method of claim 1, wherein the viral capping enzyme comprises an amino acid sequence at least 95% identical to SEQ ID NO:1.

6. The method of claim 1, wherein the viral capping enzyme comprises at least one newly introduced cysteine residue compared to a wild-type viral capping enzyme.

7. The method of claim 6, wherein the newly introduced cysteine residue is attached to the C terminus of the viral capping enzyme.

8. The method of claim 7, wherein the newly introduced cysteine residue is attached to the C terminus of the viral capping enzyme via a linker.

9. The method of claim 1, wherein the viral capping enzyme comprises only one cysteine residue or is mutated to comprise only one cysteine residue.

10. The method according to claim 1, further comprising a step of iii) converting the cap0 structure into a cap1 structure by contacting the RNA comprising a 5'-cap0 structure with a cap-specific nucleoside 2'-O-methyltransferase and a methyl donor.

11. The method according to claim 10, wherein the cap-specific nucleoside 2'-O-methyltransferase is immobilized onto a solid support.

12. The method according to claim 11, wherein the cap-specific nucleoside 2'-O-methyltransferase comprises the amino acid sequence according to any one of SEQ ID NOs: 3, 11, 12, 128-160, and 328-360 or a functional variant thereof having at least 90% sequence identity to the amino acid sequence according to any one of SEQ ID NOs: 3, 11, 12, 128-160, and 328-360.

13. The method of claim 8, wherein the linker is selected from the group consisting of SEQ ID NOs: 15-39.

14. The method of claim 1, wherein the methyl donor is S-adenosylmethionine.

15. The method of claim 1, further comprising:

iii) washing the viral capping enzyme immobilized onto the solid support;

iv) contacting the viral capping enzyme immobilized onto the solid support with RNA molecules, a nucleotide, and a methyl donor under conditions suitable for forming a 5'-cap0 structure; and v) isolating the capped RNA molecules by filtration, chromatography, or centrifugation.

* * * * *